United States Patent 12,390,499 (BACTERIOPHAGE FOR MODULATING INFLAMMATORY BOWEL DISEASE) - sequence listing, part 5

SEQ ID NO: 152 - DNA, 178761 bp, Unknown
  source: /note="Description of Unknown: M16-4a Bacteriophage Sequence"
gatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagctatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacaccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatatacttccataaaatcatgcataaagacgaaagcaaaggtatccgcgaactgcgtcaacttgatccgcgttcgatggaactgatccgcgaatctatcactgaaaccctcgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattatgcggaagtgaaagatattgagattatggaacgtcgcctaacgttaatgtcacaggttgaaggtgtagtagggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacaacgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcatccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtatcccgtgatatcaaggccgatctgttcgaatctctggtaatgggaatgaaagaactgttcgttgaacacaacgtagttatcccagaagcacaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcacaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcttccggtactgctatcgcttccggcgctatcgttaagcacgtattccaggaaactggtatcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaagactggtttcactcagaccgttggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaaaggtctgtaatcgactttacactaaaaggcaacctacgggttgccttttttgttggtgtaaatagatacaggtaaaaagccctctaattcaggaaccaaagaaatgagtgataaacactacacaattcacaagttgatgcgtcagtcttcgcttccgtctggtaaacgagaaaaagttatcaacgaagcaacaggtacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaacggtgatatgactttctccagtgctgcaacctattcaggccgaatctctggacgtacagacatcgacgaaatcgatctgactaaagcctacgttaaaggtgatttgttcaagcatgacggtactgacgttgtttatgaggtgattgcacctattaccctgaacactctggatactgacaaagacaccgcgatcatgaaagctgtgttccaaagcaagattcgtctggttagcgaagccgctgatacttctaagtatgaaaccagtgaagatatcgcgtcaacctccttccagatggatcgctggaatattccggtacgttcgcgtaagtttaaaaccgaaatgacggttgaactgatgcaggatttggaagcaaaccagtttgaagctgatggggtgatcgaagacattctgggaaccgtggcaagtgaagaagtcaacaaagacattattcaaactctgatcaccgtttccaaacgttacaacgtggatggactcgttacggatggtatttttgacggcacaaccgcatacaccgcgaaggatgccccagcattgggtcgtatcctgtatcaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatatctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctaccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatttgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgcaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcatgatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtctccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttagccactaactctttatcaagctggtcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatgcctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgctcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatggtctacgcgatcctaaaaattcaaaactctggtggtttgattctcgctgcgttctgtgatgaaattgtgtactatggtgaacaggtcgaagttgatgatgttcatcatgaaaaattcaaaagatttgtattcgggcaatataacagctattcatatggaaacgatattcgtgtgatgatgcacccgcgcattatgttggatatggaagggtgggaaccaggtcacggaattggtgatgccgaaagccaacgtgaacgccgtgttcgttcagttgctaaaactcgcgaattgatgacgggtcgccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttggcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaaatcaaatccgcctgatgcgtcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatatgaaaatgaggttagttgcatatgaaactatttcatgttgtgtatggtgggatgaaaaatatcgacatcgccgcgttatctgctggtatgctggacgaactcgaagcacagatcgggaaacgcttcaaagccagtatcaccgaaacacaaactttgtttgtcgatcaccctgcggatatggaaaaccttgtcaacactctggatgatctgatgatcccgtgtgctgatggttggaacgaagcatccggtgttcatgtagttgtaacttttgttctaaaaaatgttgacagcagaaatgccgaagtgttagagtttattcgtaaaattgattctactaaaggaaagtaactatgaaaatcgttcagcgtaatatcagcgaagttagccagcaggaaaaagtacagattcattttaaattcaatgatctgaaactgggctatgcacagatcgcccgtgagcacatgctcgataacggcgacatttacgtgattgttcaggaaatcgagcgaattcgtgctttccgcgcagaaaatccaaaagtgaaacatgttctgcgtcgtgtgtatatcaacaaacatcgtgaagaacagcgtaagcctaagaccaaagctaaacgcgatccgcgtccagataacaaacgtaaagcaatcaacggcgctatggcgctggcgttccaggaagcgggtttggtgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtatgggttgcgcgtgaaaagatccacggggctaactttagcctgatcacttcggacggtatcaaagtcattccggcaaaacgtagcggtgaaattctccctgctgaacagttctacggttgcgaacccgtagttgcgaaatactccgaacctgttcgtaagatgtgggaaatgatctctactgcgcgtcagttaagcggtgagtatagcgatgaactggtgatccaggtatacggcgaattcgcggggcgtggtgtacagaaagatgttgactacggagaaaaagatttctacgtatttgatatccgcgtcaatggtcagttcctccctgataacgttgttgcgaattacgctgttgctgttggcttgaaaatggctccactgctggcatacggtacgtttgacgagatccgcacactgcctatcacctttgattcggtggttaacctggcgaactccggtgcgatccctgcaaagaacggcgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcaatgctccttctgaactgtcagaaacagacaaagtgaagctgaacgaattcacctgctacctgactgaaaaccgtgtgaaaaatgttctgtcaaaaattgacagcgcgaatctcaccgcgaaagatttcggtcgcgtgatggggctgacggtacaggacgcgctggaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctcgcagttgaagaggcattaaaaaaggcgaaacataatggtagaaatcaatggaatcggtgtgaacgcacaggcgggaagcgggacatcgtgggtcaaacgcgaaacgcaagatgatccccgctgcggacgtagcccgacactggcagaacgtgcgcgtaaactggttgacgaaatcaacgcgaaaatggtcgaagcatcccgcaaagacatttccgagtatgtcctgaaatatccgactaaacaatcatatacctttgatatgaaacgttttatcggtaagactatggatcaggaatgtaccgaaaaagcatatgcggatctgggtgaatggttggcggaagaagggtttactttcgatacacagcgcaaccgacaagctgcgttactcaataccttcgcgggttcgcgtcgtatccagaccaattttagcgatcctaagcgtgacggatatagcgatctgacttattacatcacctggtgaaaataattcgaaaaacttgttgacgggagttatgagtgtggtaatatagctcccgtagacaagacactaacccaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgagcatgagtgaagcagaatatattgatagctggggtggctacgacgatgacgatgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacctgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacatgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctacgcttgtgtgtacgattcctgggactacaaaggcgctgtagatcgcatcgctgaatataaagagcaaatcattgctgctggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatcctcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctgttgaaagataaaaaagatgaacaccgtgctattgcaatgcttgagaaattaggcgaaaattattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcccggtggtgtggttgtgtgggttgtgggtgacgcgactatcaacggtagtgaaacgggtacatctttccgtcaagccttgtacgcgctcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgaaatcactcaacgaaggacgagattgcattcaaacacccagcaatatttcctgaacaactggcagaagatcacattaaaacgtggacggttgaaggggacttggttcttgatatattctctggctctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaaacagtcgctattacctgaactcttcaagctgttccccgaaagaagttcatacatgcgtttcattgattgtttttgcggtggccttagtgtgtcgttaaacgtccctaaacccgttctaagcaacgattacgataagacgctgattgatatgtatgagcgtcttaaaacgcttcctgacctgtctccggtgcgagaattgattgcatcgaagggtctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggtattgagttttccagtggttcattccgtgacattgatatctgtgaaaatgatttcgtgtactgtgatccgccgtacctgatcaccgatgcagtgtataacaagttctggaacgaagatcgcgaacgcgagttatatgctttcctggatgaactacacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccatgcctgaactcaaagcgcttgctggacgcgaaaaaacatccgtatgagttcgtgtctgttgcggattccgtggaagacggtaaacctgtgctgaatgaagcggtgatcgacgaactcgaagccctggttggtacgcgccggatgactatgcctcagattttccatgacgggaaacacgtaggcggattcgaccaacttcgcgagtacgtccgcaccctgtaataaataatgacaccttactgaatggtgttattatgctgacgaaacgaattaccaaaaaagactacccgactatcaagcaagccctctttgaaaaacaaggtgggcgttgtgctctctgcaaacgtcctcttgagggagagatcgagaaacatcaccttgaccatgaccatgctttagacggcgaaaacgccggacgtgtgcgcggcctactgtgtaacctatgcaacggtacagaaggtattgtgaagcacaaattcaacagatccggtctggtgtcccgtgatgttgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggctttgaatacgcagacaaagacgaacgcaaagccttaaccgcaaaatatagaaagcaattaatgaaggcaacgaaatgaaagtagaaaaacgagacggcaaagccgttgattttgacaaagaaaaaatccgtattgctgtagaaaaagctggcgggactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggtatggtgaatctgtccaacaaagagatcaccaacgagaacgcgaacaaagacgcaagggtattcccgacacagcgcgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgcggacattgaaccgcctaaatcgatcggtgttgctaccgctctcatggcgcagatcaccgcacagattgcttctcaccagtacggcgggacaacctttgcgaatgttgataaagtgctggctccatacgctcgtatgacgtatgaaaaacacgaaaaaaccgcaaggaaatacggtatttctggcgatcgtacatacgcgatggaaaagactgaaaaagatgtttttgatgcgttccagtcttacgaatatgaagttaacaccctacatactgccaatggtcaaaccccattcgttaccatcactttcggtactggtacgggtatgtttgaacgaatgatccagaaagcgattctgaaaaaccgtattcgcggcctgggtaaagagggtatcactccggtattccctaaactggttatgttcatggaaaaaggaatcaaccttgatccagaggatcgcaactatgacatcaaacaactggctctggaatgtgcttctaaacgcatgtacccagatatcattagttcggctaataaccgcgctattactggttctagcgttcctgtatctcctatgggttgtcgcagtttccttagcgtgtggcatgatgataacggtaatgaagttctggatggacgtaataacctgggtgtggtgacaatcaacctcccacgcatcgctattgaagcggaagcacaggaaaacgaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcggactgcatgaaacgctgttgatgtttggttcaggccaacacccatttgatcgtatcggctcccagaaattaggccgattgatcattgaatatctccgcgctgcaaccgaagcatggaagaagaaaacaggatatggattcagtctgtattcaacccctgcggaatctctttgccatcgcttctgtaagctggactttgagaagttcggaagcgtcaaaggtgtcacggataaaggctggtacacaaacagtttccatctggacgttgaccgcaaggtaacaccgttcgagaaaatcgactatgaagccgattatcattacatcgctactgctggtcatatcagttatgttgaattccctgatatgaaaaacaacctgcaagccctggaaaaagtctgggattatgcgatggaaaaactggactacttcggaactaaccttccggtcgataagtgctttgtatgtggctctgatgacgagttcacgcctacagaagaaggtttccactgtaagcactgcggtaatcacgatccggctaaaatgagcgtcacgcgccgtacatgcggttatttgggtgctcctgctgtccgtggattcaacgaaggtaagaacaaagaaatgatgcaccgaactaagcatcaaaattaatcaaaaagccccttgcgaaagtgaggggcttttgttatattgcacataccgaaactatgaggtattgaaaaatgatgtactggacaaaagactattttgaatttcgcgatgaagaaagttttgggactgtataccgcaatttagctttgcgtggtagtcctctgtcgcctaatcaactttcatctgtcgtgtttcctatcaaggtaacgcactgcgatcggaaaggtgtcaatgggattgttgatgccaatggcacaacatggtattccgaagattcttatctgtttgataacgaggatcgcggattctttaaaaagtttgtcgcgcttaaacctgctgttgaaaaagccgacgcgcaacaactgctggattgttctcacctgctggggcgaatttacgtagatggtaagctggtgacgaaacctggcgatctggaaaaattcttgcgtaaggcgcgggaaactaccctgaaagacaccgaaaaacgttatgatactgcaaccgccaatctacatcgtttgtctggtgaactgaaagttctacggggtgaatgatgtttccattaaaggcgcgggttcgcaacaaaaccggaacacaagaatggatggagtgtttacgcgaaactaagaactactacatttcacaggctgtaggctatgacggaaagaacatccgttataacaaagtaggcggtaaacgtgtggggatggaacaatatctccaattagaaaccgtccggcctgtgaatgttcctttcgatcttaaacgaccaaacggaaagccaacgatatgatcgggaaaatccttgatactttgtttcccttccgtgtacgcgcacgggtagaacgggaaaaccgactcgaagaaatccggttcaataagttccttgaggacaaaaagaagcgcgaagacgagaaacacccaaacgcggtaatggctgagggtgtatcgaaatgttctgttgggcggttctgggttgaaaaggattatcttgatctgataggtgcaattgcccctggcgttacgctggaggacttctcccgcgctactgggcgttcgtatactggttgtatcaaccgcttgcgtatgctctctatagtggtgcgtagtgcgcatttcggctatcgtgacgttatccgtccggtgatcccagtaagcagattaaaattttacatggcgggtggaaaaagacttgacttaaccaacgaactatgtaaaatcggttatatcagagaggggaaagttgttaaagcccctgaatggttcaccaatcaattcgaaatcaaataaggcaaaattatgttcaagaaactcgtatcgttcgtgactggtaaagttgaaactgcaatcgaacaaaacacttccccagaagaagcatggcgcagtgctgcacgtatcctgatcaaagagatcgaccgtctgcaacatactcgcgtttctgctgttcaggaaatcgcgaagctgaaaaagaaagttaccgaacacaaaaaccttcacactggtaaagaatcagagatcaaaaaactgctggcggcggggcaggaagtgtccaacagtcattacgtgctggcgctgcaacaccgtaacatctggcagggcttacagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacttccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgaggattcttgtagatgggaatgttccacagcgcgtttttcaggaaatggttgaacatgcgtgttctgaatgggataaaaagtattgcgaagaactgacgcatgatagtatagtaaacagcaacctaaaagacgcttacgaacgaagaagtgtgtacgacatttacgaaaaagagaggaaaagtgaaatgatgttcgaagacggcaacagtgcattcaaaccagcacgtaaaacttatccagactggcgcaaacagtacgcagaacagctatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcatgtgatatcgttgaagatattcgtattccttcaatcaacgtttcgcggtatagttctccgggtaacattcgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgataaactttcttctgcacgaactgattgaaaacggtatcaaatttgaattcgttgatccgattaacggtgatgatcgtcatctgctccgctgggtgtctggtagcaatccgctggattcagtatcccaggttgtagagtctgcgcataacaatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccagaaggaacacaagcgcgaatggatctgcaagccgctgtcatcaagaacgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgttacgcatacagcaatgttttcgatatcaattcaggcggtatccgccagatcaaagaactgatcacgacaaacgttaaaaaacagtgcgccgacctgctggattcaatcaagctggaagcaatcaacgatgcaaccggaaacctcaaagcggacgaagaagcgtttattgctcgcgtaaccaaaaacctcgaagtaacggttcgtcaggaaatcgttaagcgcgtgaataatgaattcccgcaaattatcgacgaagcgatcaaagcccgtctgttcccagaggcgaaaggctgatgaactttgaccgcatctataacatggatgtggttaacggtaaaggaatccgtgtagtgttgttcgtgactggctgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccgacgctcttaaaactgctccagcgcgtccgtgcgacgttccctgataaagatgtgtgggtttggacgggttacaccctcgaagccttacagggcgatacagaacgctctaagctgttaccattcattgatgttctgatcgatggacggtacgaaaaggatctaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttgggcgctgcaaaagcagaagccaaatctcgtctggaagttgtaatcaaagcccgtagcaaagatgaatttgttactaaattgcaagccctctatgagagataatatcatgatcctgaatttcaaaacccgtaaagaagcccgtgactattgctggaagtggtcgatcccgctgaaaaacatcaccaaaggaagcggttcacatccgtggacggtgagaacaaaagaaacccgcttcgaaactggtaaagattacaagctggttgatgtcgaaggtttcactgacaacggcaaaaacattgcgaacagtgttcaatcaaaacagatccaccaattgctgaacggtgttgtaaacatcgcaagccgtaacggtgatcgctataccttcgatgctccggcaggtgttgctatgaacacccttcgtgcatgggaagcgaaatacttcacagaagttgctccggctaaagccccagcgccaaaacgcgctaaaaagccaaaaccagtaggcaaaccgtccgtttctcctgcaccagctaaaccagatctggattcagaactcgacggtggcgttaacctcgctccgacaatcgaaccagttgcgaaacctgttgcaccacagccagcaacggttgaagcgatgcctggtaactttgttgcaaaccgtccgtatgttctggtagatgtagatggtttcctgcgctctcataccgcgaataaacgcattgtgcaacacatcaaaaataacaacggagttctggtgtttgaatccgttgatggtgacggcgacgcggtgatttataaagatcgtagcctcccgtttgtaatgcatcgtgagcgtaagttcttccgtgaactcggtactggcacagttcaggcagataccccagcggttcagactgttgacattgccaaacagcaacgcgataaagagatcatcgaagctgcacaggcagtagaagacgcgctggcagaacaccagaaagcgatcgaagttgttgcgcagaaagctcgcgcagttcgtgaagccgccgcaaaacttgcattgctggaaagtaagtaatataattcgggggtgcttacggcatccccttttttatttgaggtaatcatggaattattcgctggaaaaacttacggtttaaccgtatcccctgaaatctttgcagagaaaacctggaaaacaggtatcgcaaacatcattcgtgaaaaaggttatgtgacgattgatcgtacctcaatcggtgagtttgaagatcgcgcgtttatcatggacggcggctacgaatatgaactccctgcatcattatggaaatggttcaaggaagtaacgccggaagatggtgaattcaccccagaagaacccgaagaggttaatctcggtaaaggggttgaggctgaaaacggtatgcgtatcgcaacgccggaagaggtttccgctggtgttaccggatcggatctgtgcctgatggatatccctaaattcacgtatcgccctgtacaggaaaaccctctgcgtgatctccgcatcgatccatcattcggggctaacctggaaacgttgagcatcgcaccgatgccagtacgtaaatctgatgcaatgctgcgtttcgccttgcaacatgttttcagtggtggtagcatctatcaaatcaacatggaatcagaactgaaaatgcaggaagaccagattgcaaacctgttcgatctgcacacccagttaaccgctgttgagaatatcgaaaaactgttaggcaaagagaaaaagcgcattcagcaagatctcaaaccatacgggaagaagaatgaaagtcgaaatatacggaatccccgaaagtcttcataactgttacgggtgtatacaagcacaaaaactgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaactgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatgctgaaacattacggcgttgaaatcttcggtgtcgaaccactgaaaccgaagaaaccgcgtcaaatgcctaaacagatcaccgacgaagcaatcaagaaataccagaagaaatacgctaagaataaatgatctttaatacgattgaatgtgttccgtcaagtggtaaaacaaaggcgattctgaaccatatcaatcaaacgggcgaaaaagcaatcatcgcttcgatttccatgatgttatcaaaacagtcttatgactactacatcaaccaggtaaaagggaaacgagcggtgattgtggacacggatcaccgaaccaaaagaaccaacaatgacgcgctgcgtgaggttgtcaaagattatgatgtgatctttatcactcatgcagcactgaaaaacattgatgactttgatttgtataaagatttttctctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatactggcgatctctctcaatctgggacgacagtatacacccagattaaaaaacgcgtggaggcgcttttagggggcgaacagttcatctactgcaccaacacgtatcgatcgaagtttagcgaggggcaagaaatcccgtacaactcgcacggattgaacttctattcaagttatactaacgtggtggcattattcagttacaacccgttaccctggcttcgtcaaatgttgcgagcggttgcggtgtcctctggactcgaagaggaagaattagttgatgcttatgttgtcagtaaatattacgaaccagcctttcagttatgcgctcgttctgatatccgacacaacaacagcaaacgaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaactgacctatattctgccagatgcccctgttgagggtgatattatcactattaaagatggtggtggtcttgcaggggttaacaacctgttagtgcgttcaaacacccgtcagatccgtttacgtgatattcagtcaagctcttatcgactgactcacccatatatgaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtgggacgggtaaaattacgttgcagttgcctcgttacgcaaacgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatcttcatgttcgatcaggctaataaccgttgggttgtttatgacggtgatcagcgcgttcgtctgcgtcgtatcagtgatgacctgaacatgttgcctaacgattacgtgttcatcactccgattgctggcaacccaccaactgtacgtaatgtaacgctgactcttccgcaagatgttgcagaaggtgatcgcgtatatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagctacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgatcgtgacgcctaaaaagctgaacgaacgatcagcaacagaagatcgtcgtggggtgctggaaatcgcaactcaggcagaaacaaacgcgggtactgatgacactaccgcaatcacgcctaaaaagctcgatacgcgtcgtgcgagcgaaaccttagcaggtatcggaaaactcgttacaacgggcgctacgacagcggagggggctttacgtggggatgctggtacgaacgtctacaacttcaataacggtgttgaccttgtcaccccgaaatcattgaacgagaagacggcgaccgaaaagtcaaaaggtctggttgttctggcgactgaaaacgaagtggtaactggtgctgctgctggatctgcttcaatgccgatcgtagtaactcctgaaatgctgcatcgtaaaacgtctactgaatcgcgtatcggattgattgagatcgcaacccagacagaaacaaacacgggaactgatgatctccgtgctgtaacgcctaagaaactgaacgatcgcaaggctactgaatcgcttgatggtattattgccctcgctaccactgcggaagtttcagcaggtacggtaacgaataaggcagttgttccggttaagctgaaagagttcttcgacgttacgagtcatgttgcggttgcaactgctgatggtttaactcagtccggcactatctggacaacggttaacctggggattgcgtctgcgactgaaacacagcgtggtactttacgcgttgcgactcagggcgaaactgatgcaggtcttctggataccgtgttcattacgcctaaaaaactgcaagcgaagaaagcgacggataccgccgaaggtattattcgttgtgcgactaacgcggaagcgggtgcgggtactgctactaacctggcaattactccggctaccatgcagtttttgaacggtactgatccggcgtggggtgcaacaacaactcgacgtggtgcggtgtttatcactaccaaagcaaacactttcatcggtgataatctggttggttctactcaggccgttgacgattatctcgaagatttctatgctgtatcgcctcgcggtctgaactttgctctgcaaaacttcttaccgaaaatggcaacggcgcagaatagtttgagtctgggcggtgtggttgctgcaagctggatgcgtcgtgatgcaaaccagacggtaactggaaacaacacgtttaacggtacgagcaacttcgttggtaacgtaaccactaacggaacactgacggctaacgctgcggtaacggttaacaacaccgtaaccacgaacaataacattaaccagtctgcgaaagcaaacacggtgtatgctaatactgttctgagtggtgaggctgcgggaaccaaaaacctgcttcgtacattccgtggtggtgtgacggatacaatctggcatgaaactgttcaggcaagcacgtatcgcctggcgacgggcacaacggatctggttgacgttctgacagtaggtgatgtcggtaacggcacaatggcgtattccggtacgaacattcgtctgaatggtaaagctctggctaacatcaacacggcgggtgatttgtttgttgcgagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggcacgggtggacgctttaccagtgtgagcggtacggcacatgttcaggcgggtgatttctctgggaacgtccagaaaatgcgcttaactggcattgacgataaggtattgactgagtttaacatcaatatcaccgattacaacaaagcgatgatcaacggaaacctgatctatcatgcaggtcgtaaaccaactccggcagaaatcggggcggtagcggtagcgggttcaaccgtcgatactctggttgtgcgtgactatatcaaaatcggtaacgtgaaaatcttcgcaaatccaacaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctattaacggggctgatattataaacagacgaacacaagttgctcgcggaattaacctggctgtcattgatggaacaactttagcattattggattacaaagcattcgatatgtatggtgatcctgctacgaacgggaatgcgattaaagactacctgaattcacttccagcgaacagaattgtgtgtttttatactttcgatgctatcaaaagtgatgacaactttttagcaacaatgaggaaaattggttctgttgcatggcctgaaacacgattctttagtattccgacgacaacaaacagcaattcccaacgttcatcttattcagctatctattcatctacgatgaaaaagatctgtatggaaaactttgtgggtggttctggtacggggttgaaagacaatacaacgagttttgttgaagttgtgtttgatgaatttagtgatatcggggtaactggtattcctgaaagaatggttgatgatgtccagacataccagaacagcggggatatgtacggcttccatttatacggattgtggtcaatcggtaatgatgtttatctgggtgacaccttcaaatttactggggatctgtattgttcaaaagaacttcgtgatgctgggggagaagttcacctgtatatgtggacagaaaacggtagcggacaatggatcaaatcaaccattctcagaacaaccggattagcccctgatacatggcattcgttaacaggatatttcactattcctactgatgcggtaaatgctcgaatgggttcacaggtgtatcattatccgtcaactgtaaaagtcgggcttgctcagtgtcgaaatgtccaaattgctaaagtaccgcgcgaagaagtagatcgtaacggtgctgcgatcggtgtgaacggtatacgaatgcaaacactttccgaagtgactgcaacaggaacagaaaacccgattgaacaattgctttctctgcctgtttcgcctactggggttatcagtgacaagaagatcagttcgcataactttgctgaacttgattatattgtttctgatccggttgaatacacttcgacaaatacagcggagtaccagttcaaagaatggactgttacccagcaatcggcggtaacgaaagcatcactaagcagttatggcttaaaagctggtgatactatccgtatgcaatgccaaatgaaacgcgatgcgaatgcgattgctaacaataaaggcgcatatattgtaatgcagttctgggacgcgaataatacgtatatttcagggatcaacatgcgtgatgttggtacgatcccgaacgtatattcattctacaaaaacgaaggggttattcctgctggtgctgttacgtttgatttcggtttatatcgttatccaaacaacacaaacatcggtacggtatccgctaaagacgttaaactgtcaatcgtgagataaaggggcgaaagcccctttttcataaatacagtcattacaggagaaattttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgccctctcgacgattaacggcggcacggttgcaaagaatactacattcagtcagaacgtgaatgtagggcaggtgttgacagcaaatgatattctttctaatactcgcgtacaaattgcaagaacaggcggtgcgggtgcaaacttaacatttcgtcgttatgacgttaccggaaccccttcttcggaaattggtatcatggatatcaacgtacacaacggttcaggtcagtttgttggtgcatttaacgttaacgcacgtccagacggcggtaataaaatatacttccgtgcatacaaagacggaacacagaatacattattaactctggattcacaaacccaacaggtaacagttgagcaaggttctttccgtgtaatcgggacttctaacctcggcttaacgaatgctacatcaatggcagttagcggtgcgattactgcgaatacagtaaccccgacaaactgggctaaccatgatgaacgatatatgacgggcattcctcgcggtatgtctggaacaagtttcggtgctgctgttgtaactgaaaagaacgatgttctgtcagtaggcggtaacatcaccgatggcccatatggtaacactacgtattacggacaggttgttaactatcgtcgtacactgaatagtggggtttcattagttcaaacatacttcgggaacgaaatgtggtttcgtcttggaacaggttctccgggcgcgtggtcgtggaaccagggcgatgctaatggttggcggcgtgtttatgatacggtcagtccaccaactccggcagaagtgggggcagtaaacaaagctggtgatacaatgactggtggtttagcgttacttggggatttgaccttccgaaatttggtaaatcgtcatattcgtttcgaatacaccaaaaacgacggttctaccgctgttgacgcttatatctataaagatggtgtagatagccctactcgtcgtgctggacttcgcattaactgtgccacaccgaacaaagcgagcgggaatacttcaaactcaggtgattttatattcggggagaatggtaactttacactacctggtggcggtatgattgttcaggacggattgaaccagggtgtttattgtatgagtgcattaagcacaaccgcaagtggatctaagaactacttacgtaaattccgtggtggtaatagcgacacgatctggcatgaaactgttcagggcggtacgttgcgttgggctactggcaacactgatgcacaggaatgtatgcgccttgatggaacaagtttagtagttcaaggaaacatcacgtcaggaaacaatttcttggctggtggtatcatgcaaacgaacggcggttctttgtatatccgaagctctggcggtactcatacgtggtatcaagaaccagacggttctgaacgtgctgttacatggtctgatagttctggtatctatcgaatccgttcaaacaatagcaaggctgctacatgggaatttaagaatggtatgatctattattctaccccagtaaacggaagtgaccacggtttgattcgaggtgttgttgatgctggcggttgggatcaatggactgctcgatctgctggtattctgctggatgtgccaaatatccataccagtgcttataatatctggaaagtgacgaagtggggaacctctcatgttgctgcgatggatattcaccgtcctagcgatagtgattcacagacgcgagttcgtattattacaaactccggtgcgtacttctactttaacggttctggtgaatttactgcatctggtaacggtagctttaacgatgtttatattcgttctgatgaaaaactgaaaagtaatttcaataagattgaaaatgcattagataaagttgaactgttgaatggtatgatctacgataaagcggatcatatcggtggtgaacctacttcccgtgaagctggtttgattgcgcaacaattacaatcagtattaccggaagctgttaaaactggcgaagatacagaaggaaatgaaatcttaactgtttctccgaccgctgcgatcgctttgttggttaacgcgattaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggccgaaatcggattaggcaacgtaacgaacgatgcacaggtgaagaaagctggtgatacaatgcaaggaactttggaattacaaggttctgcaactgaattgaaattaccattcaggatcgcaatggttagggcaacagaaccgtatctcgttgcaactcgcacagacaataacccagtaacaaacgggtttcctagcgcagaaacacgcacatttgttatacattcaaaaaccacgtcaccaacgtcagatccaaacttgggggcaaaccttgttgatctgatttgtacccaacgccctgcgggtggtggtgcttattatatccgtgcttttggcgcaccaaacacgacaactggtgctgctggggctgtccgtgctgaattacaaatgttgggtgataatggtcttgttagtttaacggggacacaattcaacatcgggatgcaaaccgttgtcagtggcacgatctttggtgcgcaaatggctatcaaaggcgacggaaacaaaaacctgttcttccaggatgctggcggtaatgagcttagtttgatctatgctgatacaggaaagaacttatatgttcgtactggtggtggtgcatatgcaaccagatttgcatctgatggaactttagttctcgctaaccatctaaccgttcctggacaggctacgtttaacggtatgggtatattcaataaccgtgcttccgttgaaactgattatgctactcaaggagcaaacactgcaatacttcgagtaactacaaacggtgatggaaacggggttggtgatggtgttacccacttaggctataaagacagcaacggacgatataaccattatttccgtggtactggtgtaacgtatattaacaccaaattaggttttaacgtaaacgttccatcatattataatgatgttccccagggtacgccagcgcaatatttcttgcctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcgtgttatttgctgattactttggcaggtaacagcggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatcgctcaggacgttgagaaggtattgccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagttcctggctggatcggttcgtctgcggtcacagaaacagggcaacggtggatgtctgctgcgggtaacgcggttcgaatcggaacaccgttttatatgtctcgaatggcgggacaatccgtatataacatcaactttacggtgtatgagcgttactataacaacgcccgttatcgtggtcagtggggggttggttggtattcaccatattcgaaaccttccggtcacggcgcagttggtggtagttttaacggcaacgcattcggtacttgtgtttctgcacaattcagcaatgagattagcgtaattaccattcaaaacggtcctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcggggtcggcatccccgaacttgaggattaaatatggcgctattacaagataaattggcggtgcttgaacgggtaatatcgttcatcatggcggtcaaaacatggaaacagttattcattaaattggttcttatcgtcactattttcattatgttcgtaacatggtataagtgggatgacttattttcagtctggaaaacatcttcaagcgttatagacgtgccgacgatggagattgaaaaggcaaaaaagtttgaatccgcatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgccagcccgtatcttccaacaaaagaccttgttccggtagcatatacctttagttgtccttacttcaatctcgaaaactactattcaggatcaattctaatggaatggtatatacagaagcccgaagtcgccgatacgaagttaatgatcgtgtgcaatcaggccgctagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgcgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgatcggcatgatgccttgttccagcagttccagattttcggtatcttgtacagacagtttgccgcgacgttcgaacagatcgaaatctgcgaagccctggaacaccatctggaaagtatcggtctggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcgtctgtacgcggccctaacatgaggttaacgatattgacagcgtgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgttttgctaccagattgttcatttaaagcccctcaaaaagaaatatttaaggggctttcgcccctcgaattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagagttctttggcggttttaatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacctgataacggcatacacgcatcttagcgttgtcgtaatctgtcgggattgctacaacatcgcgaggattaaccttgacctgaataactttcccgcgtcctccgccatagtgaggcaggtacgattttgcggcaacatgcaaaccgcatgaacaggttcggtttttattctcgtctacctggttacgtggcatttcaaccacaacaccaggggaattatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcgtaagggcgatcgttgtacatttcgcgaacgatacgttgtgtgataccgctgtcaaacacgatatctttgtacaggactttatgcccgatgattttaatgttgcctttgctgtaaatcttcaacgcttgcgttgtgtccaacagggtagcaactccctcgatgtcgcccttaaccattaaagcatgtgctttttcgaagttagggtgtgacgaatccgctgtgatgatcttgccgtccagtaccagagtaatgaacgattcagaaccaatcattttagatttgacatctgtttgtggaagtggtttcgatgcttccgtattatacttagaatgttgttcggtaataacgcgcccgatggttcggacgcttacaccaaattgtttagccagtgcggttttgttcgcgctggtcagaaagccctcatagacagctttcttttgtacatcatcaaggatcttaacgtttctcattatttccaccgtataaggttaatcaggttcgtcttgatcttatcgtccgtaatcatggtacggcctaaagagtaagacgaattgcgcaacacatacaccaatgcagggttgcgttcttcaaacaaatcaaaggcggtatcaacacgttctttcatatctttcagcattttgtaatgcttcaccgacatttcacgaagtaacggattgcgcaccacatttttcgatttgtttttgttctcgatagtatcgtaggtaaacttaccatcaagataatcaagcaacaaatacaattctggattatagcggtttttcaccatgcgatcaagagtcacctccagataatcgcgaagggttcgaacctcgctaccatgtttagacgaaatccaggctggataccagttaggcttcatctttttcaccgcgtcggcaaaacgctgtaccagatagtcatcaagacatttcatgttgctatcaggaatgcggctccacagggagtttcgcagaaccatcacgcctttcagtccggtaactttcaacagggtcatcatactgctggcgatgctacccagtgtatagttcggtgcttctccgtccagtcggctatattcatcaatcccgtagaggcgcatagcgtacatttcatccagtttcacgaactgtgcttttgtcaggaacagatcgtttttctgtaagttaccctgatcatcaaggaagtaatgatatgccgtaggcgttttcggacgtggttcagaatcaccagaagatgattcacgcgttgctttccagcgattgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggcttttgatacgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcgaacatatccagatcgattggataacaaatgttacccatacgcgcgtatacgcctgaatagttgatggacttataacggatgatcccgcgatcgtctgcttctttcggttgccagtttacatcaacctgaacaccgataaagcgcggacggatacccgtaaacggttcataaacacgcgccgcttcacgttcccattctgcgatatcttcgactttaaccggaacggtgatttgaacgccgttaggttcgtctgtttcggtttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtaaatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgatttctcacggatacggcttttacatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcaatgaagtccaccttcgccagcgccttatctaacgcttccttagtctcctggatgcgcttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttctttcgatagatccttatagcttacgatataccctttttcttccagcttatccagaatagagatatatttcacgcgatcatacttgaccggaatctctgtgatcaccagtttggttttaccctggagttcgtacttgccgtacatcgtaccgttttcaatgtcgcctttgaaatgcgggtatttcagatccagcgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgtcaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgtacctctttcgctttatcgcggaacggtgcgaaatcttcaagggagtagaaccatttttcatctttaccgactttcgcaatgataatcggtgtgcggatataacggatctttttcttctcgaacaactcaggccagcgactaaagaacgcaatcagtagggtgagaatatcgcccccatcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccctacagcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaaaatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcgcgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttacttgttgtacgggaaaccgtctttcaccatctgcggcttatcaaccgttcgtttcgcctcgcccccgcaatcacaatctttcggttcgtcacggctcgcgatgctggacatcttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacagatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcaagatactcatagagatcgtcttcatcaccaacacaacccgtgtacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgttgtcccgtgggtagtacccagtttcaggtaaatcacatccaacgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggttgatttcagtttccggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcggatcggcttctgatgccatttgacacacagccattaaaatagatttcggggcgtacatatcaccaattttatacttgctcatttacaatacctttatgataaccaacaataaaacagttcacttctggacgttcgccagggaaatgcacacattgcatgacgcgttcagccatgagttcttcgcccaaataaacagaggtggtttcttcgttgtagtgacaacagtaagaagttttaacactcataccaggcaatccggcgatatgcataaactttgagttcgtgcatggtttaccctcaatgctctttccgtttacatcaaacgttgcaaacatttcggttttgctgttctttgggcgtctgctcatttattcacaacctcattatatgttttcaggttccattcatgcacttctggcactttggagtaatgatccaggaatactaactggacttgcataacactagcacgatccatattgaaaaggaagcgttgcggggaagtaatacacaggaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaaggggacgaagccccgattttagcgaagatagcgaacgtatccactccggtcgatcgcgttctctgggttgttgaagatgttaccacgaatacccttagcaggtgctttccagccagcggctttcaagatatttccgtcattgtcgatgaagccagcaactgaacgctgattgaacatttcacccgtttctttgttgcgggtatcctgcacgatacggtgatacttacggcctttttccagaacgaacacagtttcagtgtaatcgctgaaccacatgccagtgttacgacctttgtgcatcgcgtccagtaaaggctgtgctgcggctttcagttcgtcaaaagtatacatggtaaaatctcctaagtgtgtttcgtttcgatgtgtgtaatatactattatgcgttcaggattgcaagcattattttggttgttcgcaaatattgctcaatgcatcgcgtttaatgaacttcaatacacctgctttagcttctttctcgtcttttgcctgatacaagaagcagtcttcaccatttttagttttgacggtaatcacgaaagttttgtagttcatgcgtagttctccaggttagccagattttcttctgctttagcaagggatttttctgcggcttttttcactgctgcatactctttcttttcccatgctgcgatatcgctgttcatcttctcttcgcaataggcgatgatgcctttgttgtcgttgatctgctgaatcaggaatttgccgtgacctttgattaaagaaccgttctgcatcatgataactctccttccgtttcgtttcgatgggataactatatcaaagctatcccgtgaagtctttagcaaaaagtgctatttgttaaacccgtttcccttgataccatttcgggaaaataacccgctcgataaaagttctccccagattgaaactatcaccaaacaggaggacaccaaacaaagggtcgcgcttgatgtcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccatcgctactgcgtcgttttcgttgaaaccgttcttaaccagggctttaactactttggcttctaagtttttcatgatgcgttccttttgtctgtttcgtttcgatgtgtgtaatatacaaaaaagcctcctgtattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattattttcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtgaggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggagaccatgaataacttggcccgttcggagaatacagaacatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatgtacgcatggtcatacgtgctcccctgtgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagtgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtcagtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgcggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcacagaactgcaattcaggaatatatttcttttcttccttcggcggttcttcgtgcgtctgttttaaatctttacgatccttgaaagattccatcaaatacgccgtgtaatcatccgggtaataatctttcagaaacacagaaaacggcttgctgtagttgcagttaaaacaaccacacatcatgtgtgtgcctcgttttgatggaaagatccaaaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttcttgctccggttcagggaattccatgcagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaattggatgtctttatcttgccgaaaggtggattactgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgtttggtttccgctttcgttaacttcgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcatccagatagccaggatgaatattaggccagcgcatgatatcaacgtagcctttatcgtcaaccgatacgatccattcggaacgatacggactatcgaacttcggttcttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcactaaccacgggaacggaaagcccataagtgcgtttagaaccagtaagataaaagcgattgcaagtttcatgatgtcctcctttgtttgtttagaataaggtatcacctttcgagaatgattgcaatacctacagatacaaaaaagcccctttcggggcttgatttttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtacgttcatttggtatctcctaatcagtttttgttgtctacgggagtcatattatcacaatcataactcccgtcaacccctaatcaggattattttgcgttttttgcaatccagagagtcagtttagggaatacatttgccattgccaccacaaacagcacccagaaagccagcttaaccacaccgatcacgatcagaggcgcaaatacaagccaccaggaagcatttgccataaccccgattgctgccagtttcagagacaggaggatcaggaacacaataacgagaatctttttcatttcactataccttttgaggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaagccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgttcccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctactacatcgtcggaataaagatcttcgagtgctgccccgtcagtgatctctttgtcaggaatacggtacttatcctgaatggcatcaaggaatggctggtgagtgaacagaggtttccagaactcgatcgagttggtttccgattcacgccatttcttttcttccagttcaagttcgcccgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgctgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccgcgttccagcgcgttaagctggcttacaacgtcatttcgaagttgctcaactgtcgtgatacgagtatacaccacacgatcggggtcaacgcccattgatttcaggtaagacttagttacgcctttctctgaatcatagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgagttcgagttttggtgatgttattgaaaacatcgctttcagacagaattgacgcagattgactattcgagtttttgatcagttttttcaggagtgctttattagacatttatttttccggtttatatacacgcataatattttcctcacaaatttatataaatggggcatttctgccccgtcaggtcttaccagtcatcaccaaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattattagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggcccagaaatgatttcacgatccataaacatcaggtgttcgacgttattcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcactggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcaccgaaatcttcgtagaactcgaaatcagggttgatcatttggttgtgcgtgtctgtcaggtgttcaagttcgtgcttaatcagttcgagatttcgctcacccgccatcattcgttttttccacgccttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacagactggtcaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggtgacataaccccagggaagttgattttcgcgtagtatgctacagacagaaccagttcgataaagttgcgtttaccgtcgatatccaacacacggataacgtcaacgatgttatacgtgatgtatttctggtgatccgcttgacgcagttcagacagcgaaccttcgtaatcaactttgcttttacctgtttcgaactcagcgatcgcgcccagagcgtaagttggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcgatatcgaacttgtttgagttccagcctgtaacaataacaggtgtccgctctttccagtctttgatgtacgcagacaacagcgacttttcggtctggaatgaacggtaaacaattttcttcaagtcttcttcgctgatctcattttcggtatcaacttttgacgctacccattcatctaaaccaccctcgacaagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggtgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccagaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcatcttcatcgagaaaagcagccagtgacattttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacagcgtttgatcatttgcttcatcagttcaacgcgttcttccttcgacggagaaccgaacttgactaccggacagcgggagatcagcgcagggtgaatcccgttgatgttgttcgcggtgatgataacagtaacgttcttgctgtacgcttcgataaagctacgcatgtgcttctgtgcttctgccataccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttccacagagaaggttgactggctttctttacttttcgcggtgattaccagcttgccgttgattggctcaacagacaggtcggtcagtttcatcatgcgtgacgctttgataagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggaaaagtttttcaggatatcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcacctttggactggttgccattatcgaagtttttcagttcgttgtcaaacgaattcagttcggaatccagatccgcaccagcgcttgcgccagcacccattgcagcaccaccgaatactttggtgaacttcgcggtcagttccgccgttggtttgaactggtctggtgcagtgattggacgcagatcgctcataccttcgaagatttctttctgacgcgcttcgtcttcgatacctttgattggaccaggaacaccaaatttgctgtcgtcgtagttaggccagtcgcctactttcttcgcggtcagggtgaagttagcgccaccaaacggacaggtcacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatactgaaacaccgttgagaggggaatgcctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttaaatgtaaacctttcggctaactttttgaaaaaatacttatctcttctcttttcgaacgctttttcagtgatctttatttcccatttgtacttgatcgcgtcataccgtcccgcaaagtgatttttcatcaccagatacagtttgtataccgcaatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaagtgttcgatctgggttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggcgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagatctaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggactccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcattgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaaaaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcatgtaagcaagcgattaaacccactcctgagcgtatggcggagatcgcagagaacatcaaagcgggtacacaacgtttaaccctgatcaaaaccaaacaggacgagttacaagggatcatgaatgacttgctgcaacagcaacgcgcactcaatgccctgaaaaccaaatatgaagccctgaaaggtacactgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccttgctggattctgtagatggtaacgttattgtaatcagtcaccaggatcttgatccgcaggacttcgaccgacacatcatcatgtctaaggttgggcggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaactttcagtgatgttcgcgcagaacacgcagcaaacaagaaagcgtgggaagaaaaatttgcagcgtatttcgtgctggcgaaaaactatttcagcactaaattcaacgcgcaagaatttgcggaatatttcacgaaattcaccggacaaccaacaacctatacccagacaatcagcgaagttcgcggtcacactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgcgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagacgaagacggtgcatgtctggatatgatcatcgacactttcaaagaaatgcagaaagtgaaaccagacgcaagcggaatcgcagcagtaatcgacaggatgaacgcagagtttgcagcggggcatcgttcagcatcttttgttaaacgtaccgcacagcaagcagcagcgccggaaccagaacagaaaccgaaacgcaccgttaaccgcatcaataaagatgactatttcaacgcactgaaacaagcgggggcaacattccgcagtaactacggtgagtttgataacggcgcgggtttgactttccacttcaaacgcgagatcagcaaccgtaaaggtttctggagtttcagcagctttaactttatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttcccttttttatgaggaaaatactatgagttgtccaacatgggcgcactttgaaaacctgaaagaaggtacgcaaaaacgcgtgtttatcaatctgggatggttcgcacctacagattttgacattgctgaaattctggttaatgccagtaaagagatcagcgatacttacgaatgggactgtgtgagaatgccagttctaccagggcagtttattgatcgcgagaagttcgaagcaatgcggatcgccgtcgaaggtatcaattcgctgcatcccccaagtttgggtatgcattaccgccagcgttttaccttgaaaaccgcatggactaaagataaagaatgggtgaaagtatgattattcaggtatcggttcagggcaataccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcatcaacgctcatgttaacggtttgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagaagaaaccgcaaatagcgtcctgatcatgggtgcgaacacttttacttctctgcctggtaaattgccagggcgagttcattgcgttctgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcgttcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaaatcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgctgatatttgcgggtatgaagtgggcgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactcctgctgagattgattatctggaatcaaaaatcaatcacgataaagattttgaattctcttacgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgcaggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcacctggactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgttgtgaaatcgcgatcccaacttcaccactggatgacgatgataaactggctggcgaaattggactgtgtacgcttatggcgatcgttctcgataatgccgatataagcgaattcccagcccttacacgcatcgcagtacgcgcactggataacttgcttgattaccagaactaccctgttgcagcggctctgaaagccaaacagcgtcgttctctgggcgttggtatcaccaactatgcatcctggctggcaagcaactattgcgactactccgaagcatacgccggaaacgttcatgagttgatggaagcgtttcaatttaacctgctggttgcctcgatggaactcgcacaggaacgcggtgcatgtggactgttccatgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctttactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaggttattttcgattcaaacctgcaatatcaaaccctgctggataccattcagggacgcggcccgaacctggcgttcctccctatcgcttccgatgtctcaatggaaacgtggatcgaaacatgggcgttcagcgaaacaatccatagccgcagttatacgcacattcagcgcaacctacacatcgacccgtcgaaagagttcgataaaattctgcgcaacgaagcgattatgaaacgttcggcttccatgacaaaatactacgatgacctgatcgcagaatgtcatgaactgaaaaacatcgtgctcaaaatcgaaatgttaacgtcccacggatacccagacgaatcgatcgcagagtacgagaagaaacgcaaagagcaaatgcgtaaatgtaaggttgctctatacctgtgtatgcacgctgtcaacgctctggaagcgatccgcttctacgtgtcgtttaccttcacgttcaactttgccgaacaaggcaagatggaaggtaacgcgaagatcatgcgtctgattgcccgtgatgaagcacttcaccagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcttgattgtcgcgtcgtaaacaagtataaaggtagctgggatgtcgatattcagagaggtacgaaattcggcaatcccttctacaagggaacacgggctgaaaacataatgaagttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtgtattttattgaaatcgacggtcggatagtgtatgttggaaaatgtcgtgatttgtggaagcggttagacacataccgcaattcgaaatactggagggaagcaaaccccagtaatattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtgatgcaaaccaacgtgcgcatctttaactatcgcatggcgagctattccgactggttaaaacccggtgcgctggaatgtcgcggtatcatgtttgcgatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgaccgcctgaccgaactggttaacgatggtttcaccgtcaacatggaatacgtcgcaccgacaaaccgtattgtaattggctatcaggaaccagcagtggtgatcctgaacatccgtaataacgacacgggcgaatatgttgattatcaggatatcttcgcagatggtgtattacgtccgttcctggttgagcgcgagaaaatcgaaatcaccgatctggatgcattcattaccgaagcctacacgaaagaaggtttcgagggttacgtaatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggaaaatcacgcaaagactacgcgatcgccctgagcgctgacttaacccctgacggtcgtatcatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaatagcaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagacctgttgttcaagaaaccaggactgatcgaaatcaagatcaacaagtccttcgaagagtatatggcggagtacgacaaatgaaaatttcaacattagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggcaatccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacacgctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatctgagcaaaccgaaatgcgttatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgcgaagaaggtgatcatcgtcacgatttccacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtagcatgggcgggagtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccggcgaacaaatcgtttgttgaagtggtgacacgttcaggtactacgtatcacatcgttaaccctgataacgatttcatcaaagacattctgaaatatatggatgattgttaatgaaattcaaagtaatgaatatgttgagagcaatcgatcggagtcaacgttctcaatgtatttcgaatcgtgtaggtgctattatcgcgataggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctagcggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaaatttgcaggtgtagttcaattggtagaatatctggtttccatccagattgttgagggttcgagtcccttcacctgctccaattcgggtgcgtagcgcaatgccgttaaatggttcggaatatgcaaccatatcccacgggataggctctgttggtatccggtaataggttccccggaatgcggggtgaagtaaagaaacttccagcccactaaacaatgtgagatctatatgagaattcgtgaaaagacggtgtatgactctaagttaggcaaaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaacagtaccaattatcgagaattcgcccgacgcactaatacaatcttgtatagacgcagcatatgaaatttaaaagagaaaaatatgaaaggtcttcaaaagctgtttgaattaaccccaaaaattcgcgaaatcgtcgctgcatcaactgaaaaagaaatcaacggtaaattgatgaaactgtttaccgaagaaatcccagatttcgataacgaataccgtaaagcgttcgatgcgtattctgttgatggtttctttgcatcaccgcaggtgaatagcaaacacgaatatcatcgacgattctttgactggtcgatcgtcaatatcgttcgtcgaactgatatcgaacctacgaaccatcagttgatctctatggattcttctgtattctttatccagtaccttatcactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggcttgtactggttccccttgatattctttctggtgttctggctattctgctggctcctttcgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaacccgaaaacagaaggtggttccgatccatcacgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgatccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactaccgaagaactcgatgcgatgcttgaacgtatccatcaaatccaaaaggcgaaagaccgactgaaagaagcctctatgtgggcgtgtcgtgcggtgttccagccagaagaaaagtattaaaaatcaagccgttgccgaaaggtggcggcttttttcgtttttatgcaaaataatgcttgcactgaatcgtgagtgtggtaaagtacacacatcgaaacgaaacagagaaaaggaacgagaaaatgattaaattaaacccaatcgacgcagcaaaacatttcgtagtagttgataatggtgttgtggttgcagaagttaaggaaatcgctttctctgacccagacgcggaaatgaaaagaatgggctactcttaccggatcgagcacaaaaacggtgaagtagaatacgccgacgatatctctgacgttcaggcgaaattctaaaaagttgttgacctaatctgggggctgtgagaatatagccccatcgaaacgaaactgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaaccaatgagtaccaaagaattagaacagaaagtaatggggttcatgagtaacagcgaagatcgctatgcaaaacacctcattgtcgaactgatcaccgcgttacgtcgccgcgacaaagagatcgaagaacttaaaaatgcatcggttcaggttgtctataaagatcgcgagcgtagtagctgggaaaaagaatgggatgcaaacccccaagaccgccaccttttcgggaaataatcatgagttccattaacacagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtatcgaagtaagaacgttccagttcgaaatgcgtcgtatcccagaagcatcaatgaatctcattcgagagcacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgtcgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccaggatgtctctatcatggcatcaaccaacgggacaacatatgaccgttatgatccggcgcgtggactccataagccttacgaggttaaagcgtgaagtattacggattcaaaacgagtcatttcggtaaagcataccgcactgacaacattgatcgcaaacgtccgtactatgattctctggtacgtgctggacgcaaacgcgctcgccaggaagggaagaaggaagctgaaaatgaaacagaatagtgaactggctttgattgcttttggttttgctctgggttgtatggtttctgcattactcgttaacttcgcggggtgatgatggacatcggatcaggtagtcagtatccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtccgaaatttaacccgattacgggatctactatgatagccttgattgtcatcggtatcattctatacctcgttgttggtgtatactgcgccgcacgtttttcctggtgctttggtgtaagtcataacggatatcacacaccaaaaactttgcttttaaaacataccattttcccgctgatcgtgttattctggcctttcttcggtatatggttaatattcgcactattttttgactgagagttactatgaaagattatgatgaaagagtagaatgcgcgttcctgttcaaaggcgcgattaacccgctggcattactccacgcacagggtgctttgagttctaccctgattatgggtgttatctacaaagcgggtgtgtattacgttaccatcggcgcgaacaacattaacgtgatcaacagctacgttgaaaaatgtaagctgaaagatattgtgttcgataaagtcgaaatggatgttccaggcttcgacgctgtttatatgtacaagggttgatgatgggttacgtagtttatttcgattgttcagatcttgatccgttcgttctgcaacaagcaaagaaatatcatcaagatatcactggtatcagtgtcacgaacgatgatatgctgtgcatcgaatttgattattatcgtacatttgagcgtgacaaattccttgcggatattgaagcgtttaaaagtacccttttctttgatcgttatgaggttaaatcttgaagccagttattcttaccgacattgacgggatcgccgtgaagtggcaaagcggcctcccgttctttttgtctaaacacaacatgccgaccgatattgccctggatatggttacagatgaaaagttccgtgatatgaccgaaatcttcgggtgcgatcatcaactggcgaaaattctcatggaagaatacaataacagttcgtttattcgctatctaagcgcgtatgacgatgcgttgattgtgatcaaccgtctgaaagcccaatatgatttcgtggctgtcacggcgctgggaaccactcctacggcaagccttaaccgtattgcgaacctgaacacgctgttcccttctgcatttaaagaagtgatggttgtcgggcatggtgaaactaaagtacaccgctatctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatccttaaacgtaatgcaggtaatgaactgctgaaagagattttccgcattacgtacacgaaacagattatgtttcacattaagaagtttccgcaggtggacggcaagccaggcacaaccccgctatcgaatgctatcgcggatttgatgtctgatttggcaacgcgaaaatatacaggcaatgcagcccgtgatcgtctgctggatatcgtatcatcggtgaacgagaatgaccgcgaagtgcttcgccgtatcattaaccgcgatctggaatgtggtgctggtacaacgttaccaaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgctggaagacaagatccgcaaagcatcccgcgcggggaatgagtacgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgctttagcatcctggaaggtgcgctggctggctctggtgtaacatcggttaagttgatcccttctatcctggtacagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtatgaacacaccaaagaacctcataaggttggcgggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacattatggcaaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccggatgatattcacgttatcttcgctgatctgttttaaatagcactttttgctaaagaagccccttgcatatgtgaggggctttttgtatattacacacatcgaaacgaaacagacaaaaggaacatcccatgcaaatcactaaagaactcgaaggtaaagtaatcgttctggtaaatgaagaccgtttggcacaactgggtaacggtggtgaaaaactgccagcggacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtgaacatcgaagttgaagagtgctacgaaatcgaaaaataatgcttgcttcctgggtagtgtagtgatacattacccacatcgaaacaacacggaaagaggaaaagattatgtcaatggctcacttaactaagaaagcggattttctggctctgattgctggcatgaacgcaccgcgtttaactcgcaacaacattcaggtgtatgtgtttgacgagaagccaagcaataacgaagttcagttcccgactctgatctattgcgcttctaatttccgtgaagaaagctacatcgcagcacagaacaaattgtggaaattccgcgattggatgaacgaggcgaaaaatggttgatatgagtaaagaagccgttgaagcacgggttgcggaagcgctgaaagatattgatttcggtcgcttccttgataatgctccaacgataccggacacaatctgccttaattgtgggcgttgtgttatggttggaaaatgctgtgataacccgaatattgttatcatggaaaggaaagaagtttcggaagaagtctggaatcagattcaggaaatcattaagaatccaccagaaccgacgaagcgtttgcgtgaaatcatgagcaggaataaattatgaaatcagaaccaagtaaaactatccgcctgatccgttgggaagggcaagaaatccgttatgaagacgacgatcgcgaattcgttcatgaaatgcttgctcataatctggggttcaaaaacgccgcactggtgatgatgcagcaaaccagtgatgaagacatctggcaatgcgtcattctcgatctggacaaaaacaaggattacaccgaagatgaactgttcgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcactggttttgctggtgtcgttcgtagccgctgccacctgtacacattccaatgtttgcaggtggaaatcttttgatacatcgcggatacattcaacgatcagatacttccctgaatattcatcccctaacacctcaatcaatgcccccactttaacatccattcgaccctgattgatatcaaaccgaatacgtttttcataactggataacgtctgacacttaacagcctggaacggttgaccctgtttgtctgggttctggaagttgttctcatataccgcgttcctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacaaataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaggcaatggcgatactgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgtgagttaaaggatatcaatgataatacccttgaaaccgcgctgaatacactggacatcaaagacagcgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgatctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccgcactgttacaggctgaggttgataaagagaataccgctaaccgtaagcgcgtggacgaaaccaaacagatcgaagccgcgcaagcgaaagcgaaacctaaagcggataatgaattcgatcagggtgatgaaatcctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccacagtaccggaaacgagtgcaagtattgacaagcaaccggaagcagtgaaagcccctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaaacaagcgtataattccagtgcttcgaaggttgcaaacgtttttgcaccatcaacaaaccagacgacagcaagcgatttcaacggcagcatcggggatcagattgttgacttcgtatcgaacgttgaagttattaaatcgcctcctgtgtggtttattcgtgacttccagacaggtgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagacttccagcgaagcaacctgtttagtgttgtattcgcaaccagtccagcatcacgcattctcgacagcacgatcgggagtatccgcgatactttaattgatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggcgaattatcgctaacgttccgtgtggattcagaagcgcgtaacctgaaagtattcaacgaatggttgtcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcctataaaacaggctggcttgttgaagcagataaagaaggttgggacggattcaaacaatcacttatcgaaggggcagcaattgccgttcgtggtgtggttactggacaataaggggcgaaagccccttttgaggttaaaatgattgacataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattatgtatccgggttattcccgcaccgaacaggaaaacattttcactaaggtgtattgtgtatcgttcggtaagaacgcaatcaagatccgaatcaaaggaagcaacggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatcgtatcataacgcacttcttcgacttcgaagcagaagttggaatattcaatcattccgatcttgtttgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcaattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggctttttgagttaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcatcgtcgtattccggttcgtcgccgcgctcattgaagtgaacgattttaacatcatccagattcagttctttcagcttgtcccaaatgcgggttatttcgacgctattacatccgaacgcttccagtgtgattgtaccgtcatcgtgtatttgaggcgaaccccagcgaggacgagtatcatcaaacatatccatcagagattcaacgtttgactcaccgtaaatctttgcaacttcctgttctttaccagggcggacaagtccgatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgaccgccagttgatattcgcgtttatcgaacgccataaatgcgatcgtggctcccagaataaacacacctaatgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctggcgatcgtactttccaaacaagcggtagagttctgcgctgttgcctggcttctcaatgctgaaattatgcatcccagacagaataccatccagatacagaacagttttgttatcactgcgcaggtgtccaccgaccttgtagtagttgctgaacacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcgtcacgtttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattcagcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcaaagataaacacgccgtcctgattgccgaacttcgtgttgtattcttcatacaaccacattttgatcagagcgtctttctcttctgtgtccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaatggcggatcgtagtaaccacaatcagggacgcaatcgcccatcatttcgcgcaggttgtcgatattagtcggatctttcgggaaccggacgatgaaactacttgatgaactattgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtcgatgtcgtcatacccgcgtttgaggggcttacgattgcaacgaatgaagaacatttcgttggtattctccccgcgttcggcgtttttatttttcattcgatcaccattttaccaataacttcttcgtaggtcacagggttcggttcataaccgttagcgcctattgtatcgcctactctgttccccaccaatacagcaaccgcaactttcttaccgtctttccatgcgatgaattcgagatcatcggcaacatacgggaaggtttcgtgattgttcactgcgtcgatacagtccagaatagtatccgatgcgcaaatcagattaccaggctcacaatcaacaagacattcaacagtatagatcataataacttcctcacgaaaaaagcccctttcggggcttgattaatcagtgtccgaacacaccacggatagactctgcgaaagcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcaggagattgaatttcgcaccagcgccagtacatccgttaaacaggtcattaaaagtcatggtatgttccttttcagtttcgtttcaacaaggccaatatattacacttcgttaaaccatgcaagatatttcttctcttgtctgttcaaaacgtcataacaagaggcgacacaaacggtttcccacacaacttcatcgtaagcattcacgaagcgaatgatcagagttttgccattagtcatcaaagccggagtgaacccaagttctttaaccgcttttactttcttctggaataacgctttagtcatgttagccattttgtgtctcctttgtttcggtaaagctaaggtatcactatcaactaccggatgcaaacacttttttaaagaattttgtttccggtctttctttgtacggacgcattaccaaatctttaccgtccagcacggttggcttaccttcgagttcaatcaggatgaagttgcctttctggtacttcaatacgccctggctggcagaccattcatcattttcccagtggttgtaatgccattcaacaacggtatcgatcgggatttcaggttgatttctcataatactttccttatctgttttgctattgcctcgataactggcacggaaacggagttacccgcttgtttgtatgcctgtttcttactcgatggaataataaacgaatctgggaagccctgcaagcggaaacattcacgcggggttaatcgtctggggttcttcccgtcctgcaataccagacattgaacaccgtctttgtaatactgcgctgttatcgtcccagtgtgcgcagaatcgcttgtgacggcctgataaccgaaacccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttgtggtagtccgaaatcctttgtgttcaggcgttgatagaatacgttgtatccttcggcctccagaagcccgtaaatcgttctgaacgtcttccccttgtcatgggttagcagttcaggcacgttctcaaagaacaacacacggggctttttagcgcgtataatgcggaggatttcaaagaacaccgtaccgcgtacatcatcgaagcccagtttcaatccggctttactgaacgcctgacacgggaaccccgccagcaggatatcatgatccggcactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcgtcaatgtccgcccatagggttacattaacgtgtttgctatcttcgtacaactggcgaccatcaatcccgcccgtgtaattgctttcggtgcgttcagtaacttccagtcggaggctatcgcgcatgatctgaacaacagcctgttccagtgtaactgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcgatcaacttctttcggatatgttgaaatcgctgcaaggcgttcgacttcacccatgacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacactgacttgcgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcaacaacttcgcgcaatgcagccagtcgggaacccttcacaccatatttcgcggcttgcttacgaacataaccgaacaagccagttagttcagtggtgtaaaaacgccagcggttagcgcggatatactgccagatttgagagttaacgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaaccacttcgatcgtaagggattgcccttcggacggccttacaatgtccagttccaggatctcacgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgcgctcttacgggagtacatgcgacaaaccagagaaccatcttgtgcgatgtattcaacatggtattcacggcgttctgacgtgaagatgtctccaacaacaaccggacgatcgacgggttggcgtttagtcccttcgaaggacagtttaccgttaccgtctacggcgcattcaatacctttatgcgcgatgctcgcaacagtaacaggctctacagttccaccgatcagcattgcgggttctttggttcccagtttcatcaccagcgtttgacgaatgctacttgacataggttcagtaacaaacacataaaccatatcatttttatcacgcgcaactgattgcaaggtgtaattctttgtacctacagaacccgtgtgtttaattcctacacgatgtccaggttccagcgccatgcgacattttacatcagagataccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacaaacactttatcaccgcgcttattcaggaacgcgtcacctgtttgaatcaactgccagcagttgacaggtaaaccacccgcgcagataggacgggttactaaacagtaaggatgtttcattaatccgccagccttatattgtttggatcaggaacgaatgtatctttctgggtaatcatgaacaccaggaaagcagcgacttcgggatcttcaatcacattgaacttgcgattgcctttccaacgtaccgcgattttaccatcatcaagttttttgatttcggctacttctgatttcttgctcataattacctccttcgtttcgatgcccctaatataacaaaagccctcacgcgaacgcaagggctttttaatctttttatcagagtcccgtaaaggctacgataatctgatagtggtcatcgaagaactcaccacgattttgtttgacttcgtgcataggcatccagaacgcgtctaacgcatcgtcagaaccgcccataatacggggcagacttccatcattgttaggttctaacttgatgtactgcgccacagtcggttttgagaagtatacggaacgtttcggatgatcgaacagcatcgaattacggattgaaccacggataaccttttcaggaactttgatccgcacctcttcgagcagttcacggatcgcacaatccaggaacgtttcatttgagtttttgtgtccgccaggaagggctaacgcgtctttacctggggcgaacttacgacgaattaccagcaggtgattgttacacacaaccacactatcacccgtgcagcagttcagcgcgtcggggtatgggtagtttttgaatttctccaattcgctttcccatttctcgtattcgtagaataaacgccagaacgtgtcttccatcatccatttgtcgatataatcgacggttgtttgaggaacaaagcgcagcagtttcttatcccatccgtttttgtggttgaaaataatcggacgcagatcggttgctgatagatccttgccgtcaacccgaacaggatcaacaggtacgtgtgtccatccgaacgctttaagccagtatgaacccgcatctttttcgtaaccgtagatagcgattttgtcgcctttggtttccctgatagcagtacgaacagaggttttccatttctcttcgttgtaaagataatctggaatgtgttcaaactgaacacgaacaacatcttcgatcgggaagttagcgtttaaccatgagaagatcatcgtttgacgctcacgcgctgtcagagggtttaaaacgttagggtaagcgtaagctgaacccaaaaggatgtaaacggtttttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaaccgcctgttgagcgatttgctctttacgtgccagttctgctttttctgcgttcacctgttcttcacgaattttcgtgttttcaacctgcttcttgatcgcttctggcagatcgatatcctgcaagaatacctgtttcacggtgtagccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttacgatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcacaacctgatttgtgtttccagttggttgtgtaccaacgcaaaccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccagcaaccagtaagaaccctcgaacagattcaactggaaatcagtacgcagaccgtaagccattacagggatttcgagttcatcgacaacgcgacatagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgtgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatattgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgaccggatagtctccagtacactcgtcaataatagcgctaatacgcaaccaatcgcccccagcaagccccgcaccgataagaggggtgatgataggcaatttttcaggaaacgccctggcgcgttctacagcgctcacaaagcatgaccggattgcatcgtaatccacttgtgggccagtaccccagaatttaaactgggtgtatgcgttgaagacaatctgaccttcttccgtcatgtagatggagttagtgcctaacttacgctgatcacctttcatcgtcagtgcatcaattttgaacgcgccagggattttgtgcttaacttctttagcaatacccgcgcccatgttgcaatagcagttacacccgtggatcaggtgtacttttcgtttcaggaacaactctacagcgttccctttgatttctttaataatcattttcatcacctgtatagtggcggtaagccagcacagccagccccgcgatcacaaccacaacacacattaaaatataacctgtgttcatttaaattcgtcgtcccatctttgccacgcttccaactcgtcgtcatattcagggaacgaggtttcatttggctttttaacgtaataccagataatgattgctgctgcaatcacacacccgtaaaagattactaatcccatcatcagtataatcctataccagcgttatattcttcaaccaggtaagtacgaagtttttcacaacgttccttatccggcgctttggtgcagaggttcatcattggttcagactgcaagaactcacgctgtttaaccaacttctgacgcttgaagaggtgcgcgttttcttcgccccacacataagccgcgtccagttgttcagcaatcacttgttcacatacggcaacgtctttaatgtcgcgatggttgcagagttcagccagtcgatcatcggcatgagcaaagccagcaaacagggtgagtaacagcgcaagttttttcatcgttttaccttagtatgaatcgtcttcgataggggtataatatcgactttcgcagatatacgcaagcactgatcgcaaactatcgctttcaaattcgggtttttgtttgcgtttcaggctccgacccgtgatacacatccagcgttcttccgcaacatcaaaggctaaccagtatgtgtcatgcagtgaacatgtatgttcgaagacatcaaacatcagtttaccgtcaatcggcttaacgtatggctttatgcgttgaagagatttcaggactgattcgaggttactgcgatcctcattcatcgcgatacgtaggatatgctgattgatttcagggttgtacccgtcgatcgcaagtcccatatcctggaagaacttagtcgcatcatggaaaatctctcgtccgctgttcggtgaattgatgtaaaactccatgcgtttcttcggagtcatcgcgcggacgcgggaagcggttttgtgatcgatctcttctttgatgtctttgcgagcatccagcagtttattcagtttttcctggtaaggtttcattaccgccctgatttctgcaatacgttcatcaacgatcgttaactgctgttccggtgtcagtttagtttccattacgcccccacacgcacaaagcgatcttcaattgcatcattaacacattcgtaaatgctaacgtcattagcgacgtgcttacgaatacctactttcacgatatccatgatctctttgttgctaccccatacgttcaggttgaagtaaacaccgccgctatgaattgtgttgttgccaacatcacgatatgtatcttgactttcacagataaaaagtctgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtcgggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagtttttcgatcgtattcgttaccgatcctgaaagcatactccaaaacctttttctgctttggtgtaatttcgtccaattccttaacatagctgggggcattggctggggctttcttcattactgttgcttgttgtagcggtaatgttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaagcgttcggatcgtacagagctacgatttcatcaaacgatacctgaaccacatgtttaaagtgaacactccagccagtcgtaaagatttcgctgttgtcgaacccgcaatcagggctgaacatggcgcgatatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgcggcatcaatatccgcatatttaagcactgcataacgttcttcgcgtttcatactactacatccttatcacagactggacaccgaatcacacgatacacatcacgaccgccagtgtaatcagtagataccttttctttgacatcctgcgcagtgtatgacaggacagcaccacaacgacaggtagtttgttttggggtaatactcacaacttgaaccataataacctcacaagaatagtttcacttcgctaccgcatttcgggcagacgatatgttttttcacgatgtaatctgctgcattgaagaaaccattataaaacgcttcggttctcttctgtacatcagacagttcatactctaacccacttttgcaattagcgcaaacggtaattagctttggactgataataacgttgatcatgtatacctcacgaaaaaagggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtattgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttccacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacaagttcaccatccgatagaatgtattggttcgggtaataatcgccgtcaggaagcgaggaatagcttatttgggctacttcgccaacatatcccaacacctcgacatcatcccagaatccagggatatcgacatacccagaatacaacacatcgctatctttcagcgagtcatcgcccgtgtattgttcaacaggacatcccttagacatcgcgatcaacagcatgttaatgtcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttgcttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacatagatattcagtgtccctttagactgcttgatgatatcgaaagccgctttggttttacccgacatccgacccatatccagcgcagtttcgaagatagacaccccgccgcattcttgcccccagcgcccatcaatgattcgcgccaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcggacaccgaaatcaacaggcgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgattaataatcatcgtaatagagataaccgaaacattcgtcaaattcacgtttacgtttcatctgttcttcttttcgctctttcatatcaggaggaagacggtcttcattgacttcatcaatgtaagcctgtgcatcctctttggtcaggaagaacgcatggaagttatatccgttgcgcccattcatactacgatcgtcaagagagaattctgtgtgacagtcccagtctttgtacagggtgatgcattttgcaaacagcccaataccgcgatgcatacgagggaagccagtaacaatcatcttgctacccatttccgctttttcgccgttcacgcagaacacttcatacatgatcgcaccaggtttcacatctttcttgagagcacgtttttcaaaagcacttttcataatgtattcctcacaattagttttcatatacagattaccacaatctgttttgatgtcaacaaggtctatcgtttttatttgggaaagttaacgtgaacaggcgatcgtgtaatccctcgatccgctcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgtagcagtcagtaacaactacccaaccttctttcgctttcattgcttctttgttcgcttcaaccatttccagcatttcgttcagtaagttcattttaatccccttgtttatctgttttgttgtctacgagagagatattatcacaacggggattagtgtcaacagttattcgaaacgaattgtgctatttttgaaaaatattccagagcacacagatcctttgatctgcttgccgttcacaccagttgcttcgaatccggttgagtatgtgtctttttcagaacatgcaaaccacttgtaacccgtgaactggatgttcgtataaccctgtgcttccagggtacgctgtgcctctttctcgtcagtacagcttgactgcaagaacacaacaacgacaaccatcaaaatacacacaacaattttccacataatttatactcttttaaggttagttttgctggcttcgatccagcctgaatagaacggggagaagtcctccgctacacccaaacaaacggtagtatgtccgaatgggttcggtgtcgttactttactatcgggattgatcggaagttcactagccccaacactggtcgcaaacaccataccaccagttacgtaaatggtttgaatatgcccgtaagcatcgccaggccacttgaaacggtattcagtgttccataccttgacgttgtacacatcatattcatcgaacagaggatcgttgccctttgtcgcttcgtaaagcgcaccacgccattcaactaaatccgcttcgatatcgcttacacaaaactcttcttccgcactcagtttatcaagtatcatttcaatagtacggatagccatacttaattcacgatcgagtttcataatcaatttccttaacaacggttaaattcttttcggttcttagcctgaataattccagcgcttcttctggggttcttccatcgtattggatagtatgaataccagatttaaaagtcaatggaacccagaaaaacccaaatactcgtttctctaacttgtatgttctttcaggaacccatccaggcgtatgaacttcaactacccgaattttcatacaataccctcttcttcgagcacttcccagatcaaacgatccaggtgcatcaggttccacataaccgagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcgactacggcggtacacttcatatgcttcatccttttcctgtgcagacatccgattataacggatctcttcgcgcagttcaacttctctcacggcttcggctttcttttcagcggtgagtatgtgatgtactacagcgtttcggatttcccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcactggatagtttcttacggtaacagtttcaccaaccaaaggcgacacgtccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcgttgatgtaagagctaaacatcgttgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcccttttgtttcagtcccaggaacacgatcgcgtttacttgtttcaggcgcggatcattcttcacggcatcaaccacgttaaacgcgtcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcatacgccatcatatcgaacatatcagggtttgtttgcccctgtgcatcagcaccgagtgcgcattgagtcagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtaggttttgatgtacttcccgttaaggatgcgaagctgttggaaaactttgttacacaaagcacgtttcgctttgtattccggcgtattacggattgattcgatcgtcatacccatttcatttttagggtaagcgctcaattccctgccgatctctctgtgccagttgcttaactgatcacgctgtgctttgtactcttcaaaagttaacattataactgatctccgtaatctttcgctgcatcttcgggggttgcatccagtcggtaaagctcaacagctaacggactgggtttgatttcgcggttcaggatctcactgataccgcgaaggaactcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccactgtactcacatttcacgttccggtacttgatgtaaactgctgcaacatcttcttttttgtagttccggcttttgtagatgatttccataatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcattactgcaagggcttttttcactttaatcgaatttttctggcaactgatctacaattacctgagtttgatggatttcttcactcaatttatcgcggtaatgaaccagttcacgggttctggatgctgaatagctaatgattttatcagcggtagcggtgtaaccgtaaccagcacacgcgatttccagttttgcgttatcgccattcggtacgcggatatgagcatacgtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagtgcaggtaatgacatattttcaaaggttcgctgttcgtgtcggggtagttcatgccagaataaacgggaaccgtccggcataggaagaccaatttcaccttcgtaaaatttgataatcgtcgtcaggcgttgtttaccgtcgatgacttctacccagtgagtttcattgaactggctatcaaccgcgatcgcgatgacaccacaagggaaccccgtcattaaggtagtcagaaacgcatcttgttctttctgcgtccacacgtaggggcgctgataagatggattcagatccagatcattatgcttccaccagttgagataacttccaaccatgatcgcatgatcgcgactacgaaaagttcggagttcccgaagtcggttatgaaccggaatatcatctttagacatgattcaccacccaacccagcaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttactttcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcagtgctccgaacgaaagcagccccatacgatgatcgttatctgattcaccagcgcggaattcgaatttcttgccgctgatactgatagcgctgaaaccgtctttcaggtatggcaacagatacagagggatcagcatcatctttgaatcgtcttcccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaagttgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggtcgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttgttacccattgatatcttattccccataatgttcttcgtagtcatcgcattcagggagataagtttcgcagaacatacacagcgtgaagaaagtaggctggcgaattccgacattatcgggtaagtacatccagaacgtgttcgcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagttgggtatggataactttgcgcttcccacagataaacaatggcgtgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttggtgaagccttgcccgttacagatatcacaggtaacgttgaaatcttccatctgatcaacccagccagaatccggcaagccagaaggatacgtgttgacacgcacaacttcgaaccctttaccctcgcatttcgggcatttgtgcgggtactgggatttaaccatactcagcagttgccccagcgtcgttgaacgatcgaagcgttcgactagtgccattacatcagcaatacgaatcgaaccagcgtcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgtctcctttgtttcgacacccctaatataacaaaagcccctgcacgaatgcaagggcttttttcaaatatttttcaacatatgcagttgaggaggacaatcttttgaagcaatcaggcgatccaggcgtgacataacgcgtctgtagccgtcatactcgaacttgattttgggtgcgatgtagttcacatggatcgcgtttcgcgtgttcaggctcaacgtgtactcagggataacggttcggaatcgtacagcaatcactggtttttcgtgagcaaccgaatcatccatgttttcgaacatctggacggtgaacgcacaggcaaacactttgccattgatccggcgatatgcaatgacttcctgcataccttcgtttttcgctttcaccgcgtaatacagaacgttacacgaataatgtttagcgagactattaagaatttcactgtagaccgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacgcccacgatcgtattaccgtatttcgtttcccacttctccacgtcaaccagtcggacaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaagggggctttcgccccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaacccttgctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaatagcaattgaagtccatatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacctgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatctattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaaacctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcaggtaggctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttacgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggtggttttggcttgtcttcttctgcgatgatctcgaactcaaaaataaaactcataattccctccgtttagggtatttattgccctttccatccgaacacacgtttcaacgtgtcctctgtgatgatcttgaactcccagcccttttgttttgctgctgcattcgcggctttccatttgtcaatgtttaccgcataagtatacagcgcatcaacaaatttctttttgttgtgaacgttgttgttcgctggcttcggtgggggcaacgtttctttcatcggcttgacttcccaaaggtaggtcacaccgttatccatttcaacatagaaatccatgaaatagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagacccgaacaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggcgagtatcctcgttatgtaggtaacgatgtcaacgtactggctcgtggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgagtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttacaatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgttaatcagaatttaatggctaacgttaaacagaatgcaactgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaattttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggtccccgttgcgatccgcgaatccgacaggtatacaaccagactacaggcgcgtttaccagcattgattactactggaatggtaatcgtattgcgtacatgaaacacgacgaatcccccgcgcaccagtgcaaatatacagggatgtcagtaaacacgaacgcagataccagcattcctccggttccccctgctctcccgtcaacgtatggggcgctaccgagtgaagccagattgttttctgctcgctctggattgggctgtattccggcgaccgtagggttcccgtatacgaatatcagcgatgctatgctttccgcgtggaacgagactcgtaaaacgttcaagctggctttcgatatgctgacgggtacgattaaaaacggctctggtatcgcgacgatgtttgacgggctttcgatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctcccgaaacaccaaacccgctttggtctgctgtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcaggggcaagaactattcaacaccctgaaagcacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattactgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaataaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaactgttttttatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacaacgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccaaccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaagggcagacatggcattactacaaagcatttaacgaccgcgtaggaaaccctgtatcgcgctctattgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgcgctgaaacagacaccgatcgacaccgatccgagttctccaacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgaggaagaacgtttttatatccagcatgaatacaccaatatgtcaacgaacggcacggagatttttatttccgtagcgaactacaaatatccaggcacacttcccgatcctgaattgttgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatattacaacgaggcgaattatagctggttcttccgcgactctgtgcgcacatggatcactaatgataaccgtcctctggtggtgtatccgaaaatcacctacagccttgtaaccgatagtgctggtccttcgtcatcgcttcgtgtgaacaaagaggtatgggatcgcggacatgttacgatttacattaacaacattaagtttaccggattcacaaagtatacgaacggcgtgttgctgtataagagttcaggcgaaatcatcgggttctttgaactgagttaccgcgctcgcgataacttaacgattttctggaaaccagacaatacgttattgattgccgatcttattcagcaggaacgcgaaaaaccgtatcaaccggatctgtcacctggtttgattgacccagatttaagccatatgattacgcgctttgcgcctcaaagctatctggaacagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaacactctggaatatgatattctggttcattcaacaaatatcaaccaggacattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgacgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacacccccgatcataactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaacccaaaaatcttttacattaatgacatcgtggttgtaaactccgcgccttataaccgtactgactacggtaaaggatggatggtataccgcgttgtagacgttcctgatattggatcttgttcaatctccagtatcacgggtaaagttgaatgtgtgcgcattggtggcatttggacaccgacccacgaatcgatcgaacctccgcgcggggaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacttattattcaggcaacccgatcgaactgggttcattgcatgatatggatacttcaacagggccaattactgttgttcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgaggatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagaacgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgccgcatggcgagcgacgtatgaagcgcataccatgcgcgtatataacacgggagacacagaacaggttagtatccctggtgaaatctgggttggtgatctaccaaacaaacgcacgttcactaatgctgaatttggtatcagtccgcgaattttgattaacccgaactcgttcgaactgctgctgaacggtcgccagcttgttaaagcaggcgatgcggatctcccgacatttgtttgtgagggcgcagaaggttatgatgaagatagctgtattgcgaactccggcgcgtgggttccttctggacaggattacagtctgatttttgttgactccgtggttactggcattaaatttgctcaacctctggaatcccgtgatgtggtaactattcgctggttcaacaatgatatcggtactgtaatggaatgggacggtgtaggcggtattaaagaacacaccgataagatttacctgaacaacgaagaagaagtgacgctggttaatcagatcgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggcgattatatgggctttggtatctggacacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgtgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcaacagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatacggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggtttgcctaatgccgcgcctggtgtgcgcggtattgctgctattgcgacacaggcaatgattgatgcgggtactgatacccagacgatcgtaactcctgctttgctggaataccgtctgcaaaaccctcatgcatcacaaaccgtatggggttacactcgttacgcaactgatgcagaatcagtaacagtaacaaacgatctggtttctcttactccgcgctcgttgaactatgtgtttaacacccgccatgcaaaagaaaacgtttggggttctgtgaaactgtcaacaactgctcaggcaacatccggtactgatgacactaccgcaatgactccgcttaaagtgaagcaagcgatctctgctctggttccggtacaggcaaacgcaacagaaagttcgtttggtcttgttcagttagcaactgttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcaatgaaccgcaattcaaacccagaactgtttgcccgaattggttatacatacggcggttctggtgatattttcaacttgcctgatatgcgcggtcttgtagctcgcggctttgatggtgggcgtggtgtggatgcaggtcgcggttttggtacatatcaggctgatatgtttgcgtatcacgaacatgatctccagatgatttaccagaacggcggtaatcttcctaagagtcaagcagtttatgaactgaaaggcgcggaaaaaaatgaccaacgtgttatgcacctgaataacgattacagcaaagcattaggtactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcgcaggttatgaccgatatcggtactgactcccagccaacaagcatcaaaggccgtctgctgaatgtggaaaacacacagcgcgacgatcaccaggcactggttgatgttaccgcaattgtgggtaatacgtcaactggactcgttgcggctaatatcgcgatgggtaaagctgtttatggtgatgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcgccaggatgttgctgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattgcggtacatacggttcctcagttcgatacaaacttgagcgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaactactcgtccggctctggcgtttacaacggatcttccggcaacgaagagttatacaacaggcgataatatggatttagccgttgttgttactggtggcaaaacaccatatacatacaaatggtttaaagatacggttgaagttactggggaaactggcgcaagcctggctacagtagcagaagcgggtgtgtacaaagttgaagttacggattccgcgacttctccggcgaccatcacctccgctgaatgtactgtgacggtagcataattttaacaaggggcgcaagccccttttgaggatcatatgattacgaataatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtgttgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaacctatccgaaatcttgacgggctggctgatatcaacatcgaacagtacgaagaagacaaagaatttgaaagagaaggtgatgaattcatcgaatcttttgatgttgtcaacggacgcggttcaccgtttgcaagtctgccataaatacgttatatgggtataggcggaagtctataccctcttcgaagaggattttatgatatggttgcaaaaatctctatagaacaaagagaacatcaattaaaagaacgttgtgcggaattagaactatcttttgatggatgggtagaccaatcagcgatcacaaaatattcaaagttttatgttgtttgcagtaaaggacatagaacagaaaaacagatcaaaccatttgtcaacaaaagtcgtccaaacggatgttatttgtgttcccctaagatgaaaatatcaaaggaaaacagaatcgaggaaatcaaaactcttgcagattcaattggatatacattcgtagatttcgttggggtgtataaagatgcgcacacaaaaatatcaatggtttgcgataaaggccataattgggatgtaagtatagttgcttttctcaatcaaggtcatcgctgtaaaaaatgcgcaacgtctgggttcaatccgaacaaaccagcatacgtatacgtacaatcactatctggaaaatttctgaaatttgggataaccaacagaacaccaaaaaaaagaatgtgtgcgcaatcaaataaatccgtttataaacacgaactggtttatcaaaaattattcgataaaggtattgatgcaatgagtattgaacagaagatcaaacaatctcttgtttgtggcgtagtcgataaatcagatatgatggatggatatacagaaacaacagatatatccaattacgataaactgttgaatattatagaaggagtataaaattgtttggctactggtataatagctcactgcgtaactatattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtttacacgcgatatgaagatgatatgttccaaatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgaaaatggatgaaaaattagatttacagcaattgctgaatattgattccctccctggcggcgttgagtctggggaggatgtggttgtttacgagaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaaaggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcagccagtaatttcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggcgacaacggtacatttgatgacggttattcgtggtctgcgaagatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccg

SEQ ID NO: 153 - DNA, 177411 bp, Unknown
  source: /note="Description of Unknown: M16-5c Bacteriophage Sequence"
aatacagtttcttcttgccaatcatcaaaaagattcgacgcgataagaccgaaccggatgacattcacgttatctttgcagatctgttttaaatagcactttttgctaaagaagcctcttgcaatgtagggggcttttttgtatattacacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgcgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgtgttctgggtaatgtaatggtacattacctacatcgaaacgaaatacggaaagaggaaaagattatgtcaatggctcacttaactaagaaagcggattttctggctctgattgctggcatgaacgcgccgcgtttaactcgtaacaacattcaggtgtatgtgtttgacgagaagccaagcaataacgaagttcagttcccgactctgatctattgcgcttctaatttccgtgaagaaagctacatcgcagcacagaacaaattgtggaaattccgcgattggatgaacgaggcgaaaaatggttgatatgagtaaagaagccgttgaagcacgggttgcggaagcgctgaaagatattgatttcggtcgcttccttgataatgctccaacgataccggatacaatctgccttaattgtgggcgttgtgttatggttggaaaatgctgtgataacccgaatatcgttatcatggaaaagaaattggtgtcggcggaaacgtgggatcagattcaagagatcatcaaaaacccacctgaaccgacgaaacgtttacgcgaacttatgagcaggaaaccacgttatgaaatcagaaccaagtaaaactatccgcctgatccgttgggaaggtaacgaactccgttatgaagacggcgatcgtgaattcgttcatgaaatgctggcgcacaatctgggattgaaaaacgctaacctggtgcagatgcagcagacagcagatcctgacacatggcaatgtgttattgtcgaactgaatcctaacaaggaatacaccgaagatgaactgtttgcgctcacagagaacgctacagcgcgtcagaagtgcttcatgattgatatgcctcgcgagaactacgagaatatcaagaaagcccgtaaacagaacaagaacaacgtgttcgacctgttcatgggctatcatgaagaaactacggcctaagcctcactggttttgctggtgtcgttagtagccgctgccacctgtacacattctaatgtttgcaggtggaaatcttttgatacgtcgcggatacattcaacgatcagatacttccctgaatattcatcccctaacacctcaatcaatgcccccactttaacatccattcgaccctgattgatatcaaaccgaatacgtttttcataactggataacgtccgacacttcacagcctggaacggttgaccctgtttgtctgggttctggaagttgttctcatataccgcgttcctgttcatggtgatccatgcgttttcaatatcggtactcgcaaggatatcactgtacagttttttatccgtcatcgagaaactaaagaaacttgcatcccctaacagggtagtgttatccttatgggtaatgtattctgctttagtgaataccaaagcgtcacctaaaaacgggttacttacgttgaacttgtaagcctttaacggggtttgtgcgaggatctccgtattgcttttcataaagataccagaaccatcttcccacagataacagaagtcagacgaatctacgctctgcccgttgtcacggatgtaatcaaacacggtttcatacgtcccgctcaggcaagccggaggaatacgcacgtttgatgcgtcgataggcggcgtgatcaacttcatatcattatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacattcgaatacagaaccccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggcgatactgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgtcggatgcagaatccaccaaaaccacaggcgcaaccaactgttcggaagatccaggcaacgttagataaagattcgatgcgcgagttaaaggatatcaatgataacacccttgaaaccgcgctgaatacactggacatcaaagacagtgtgaaatcctttgaggatcgtttcaaagagaaattcgctggcttccaggaacaatacgaacaggatcaacaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagtaagcgcgttcttgcgttgctgggttcaatcaaggataatacatctggtcttctgtctcgctttatcggatactctctcgaagcgctggcgaagtttgccaaatggactttgattatcggtagtatcgtattcgctatcgacgttctgagcaaggttattcagaagtggttccaggatattctcgcagagggtgaagcctcgaaagagttatttggatcatacttcggaaatattaaagcccttgcagaaaaaatcaatgaagggctgcaaaacttcaatatgaaggatttgggcggatcattgaaaaacttgttcctcgaaccgtttaaaattctgggcgataccattaaaaccgcaatcacggaaggtatcggtaatctaatctatgctctgggcgaatataccggatcagaaacgattactaacgccggacgcgggatgaaggtatcagcgctacgcgataaacagaaatacggtcttgagattgataaagatgatttggttctgttgaaacagcaagagatccaggatcagaacgataaagttgttgaacagcgttctaagctcgtcgatcaggttaaggctacgcagggtacattctcatatagtttcgggcaacagacagaagcacagaaagcacaatccaagcatcttgaagaacttcgcaatcaggtagaactcgaagagaagatcaccgaagagaagaagaaagaactgaaagcattgcaggaaaaccctgcactgttacaggctgaggttgacaaagagaataccgcgaaccgtcaacgtgtagatgaaaccaaacagatcgaagcagcgcaagagaaagcgaaacctaaagcagataatgaattcgatcagggcgatgaaatcctgaacaaagacaatctgacgggcaacgataaaaaggtaatggaaaaactcatagaatcgcttgaagagaaaaacaattcgaacaagctgaatgaggacgataaagaccgatatcgtgatatgatctcccgctggcaggaaaaaatcaccgcagtaccggaaacgagtgcaagtattgacaagcaaccggaagcagtgaaagcgcctgttcagcctacaacgcctaacagcgttcaggtcaacaacaaaacagtaaacaacacggttcagcattcagtccaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcgtacaacgcatcaagcctttataataacggcttgctgtttacagcatatgatttcagtggtggacttgcaccaggaagcaaagataactatcgctcattgcgtcaggccgcacagaacgcgcaacagatccttagtgccaacactgggaacgttcgatacaaacaggttttgaatacccgtactatgggtacacttaacccaatttgtcaaatacttttaccgcgaagcctgaacgataacgaagtgaactcacaccgctatcaggacgcgaccgatagtattgttgctaaaggtctatcccgtgcagtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgttgggttatggtactacttcgggtggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggtgacagtttgcggttccctcattctacatttgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaattgatggtactatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtacaatatggggttgagcatcgttggcgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcctataaaacaggctggcttgttgaagcagataaagaaggttgggacggattcaaacaatcacttatcgaaggcgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacatattcactaaggtgtattgcgtatcgttcggtaagaacgcaatcaagatccgaatcaaaggaagcagcggacaatcagaagcattcatgcatgtaactgattacgttctgcaaaatgaatatgcccttgatgactcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctattcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcagacatcagcgcgattatgtttacattatggctctgttcgacagtatcaacaaagagactgtagatctccaaatcaaatgccctgaatgtggggaactgattaagtttgtgctcaatcgtcatcatatcatggtggacgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgaacatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgagaacgcgatcaccgtaacgatttactacagcatcattgatgaaccggaagaaatagaaagaatcaaactccagctatcatcctcataacaaaaaagccccgaaaggggcttttcttattccatcacgatccagcccattagctgttgatatcgcaattcgaacggagtgatgaaagagcggttattgacaaccttcgtcccgttataggacttaatcacttcctcaccacgaagcacatattcgtatacttcatccatcgtatcataacgcacttcttcgacttcgaagcagaagttggaatattcaatcatcccgatcttgttcgcgtaacgacgttcgatacaaccctgtttttcaatctgagtaatcgcagtatcaatgaactgcgcaagtgcttgcatgaaattactacattcgacttcacggcctccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttatttttaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccataacgaggaacttctaaaacgttcgcaccttcgagcaggttgctttcgatgtctacgattacatagctctcaccgattgccgcgccttttctccagtcttttacgaacttcatcattttagctttcatgttctcgttccttttggctgttccgtttcgatatgtgtaatataacaaagccctcacgcgaacgcaagggcttttttggattaactgaatttattatagagagtaaaattaatccctatagaattcagtgctttacatgttgcatcaagatctgttggttcgatttcgatgatgtatttcaacgctgtgtttactggaatggtttctggttcttcgaaagatgccagggttggtgctttcaccgtttctggttcagcaagcacggttttctttacgtcaaacgcttctttgaacttgttgattctttttagcaggtcatcaatcaattcgatgttagctccgtcgaattgtctggtttgttccagcatactcgtaatctttccgtatgtagtgcgtctggtttgttccgtgtaattcccgacttcataacggtcgatccggtcgatgattgcccgaatgtgtccaagattagcgcgatcgaaatacgcaatcagcttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccattccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacatttcgcggttatctctcaggagattgtatttcttttcgagttccggcccgaatgcgtccgcgtcgtcataccagtcatagttataacttccggtttcatcgtcgtattccggttcgccgccgcgctcattgaagtgaacgattttaacatcatccagattcagttctttcaacttgtcccagatgcgggttatttctacgctattacatccgaacgcttccagtgtgattgtgccgtcatcgtgtatttgaggtaaatcccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacgaatcttcatcgtcttgcctcatatttcgcgttctccgcgattttctcatgatacaggttgtatgacaacaccagcgggatacttgccacgataaggccaatgacaaccatttgatattcgcgcttatcgaacgccatgaatgaaatcgcagcgcccagaataaacacacccaatgcaatgataaagaatagagtcattttgacagggtatccatgcagcgtgatttttctttcaggatggtgatcacagtttccatcgcctgttgtacatcaccgtcaaagtgaatcaggaatgttttgtgtagtcccatgatcagacggttgacaatgtaagccatttctgacggcaacagtttaccatcttgatgattgtacttctcaaacaggcggtagagttctgcgctgttgcctggcttctcgatgctgaaattatgcattccagacagaagaccatccagatacagaacagttttgttatcactgcgcaggtgtccgccgaccttgtagtagttgctgaatacatacgggttttcgcggatatcttcgataccgaattcaccatgatctccgatattgccaacatgggcgaagaaattatggtcttccagttcgagaaggattgcaccctttttgtaagggaacccgactaaatcgatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatagtattttcctcaatatgccccctttcgggggcggacattgttagattttgacttctttttcttccaggacaatttcacattcgaatgatgtggtttcccagactttccagaaatcggacggaatattatcttctttcggaagaatatctttcgcagcgatagaaactttggtttcttcgaagtccagatccgcgaaccatgcatgtgctactacaacaccgtacattacgcgacttaaacgagcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaacagacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgattttttccggcagaccgaattctttctgtttgctttctgggatagtcacatacccttccagatccgtgttgatggaaatgttaggacgggaactgttacccaccagatgtttaaccgatactttggttgtagtctgggtgaacttcggaacccatacttcatgcgctaccatttgcgccgccagtgctttacgttcttctggggttgcagcgtttgcgatctgttcagacagttgatccagtgtatcatcttctttctgtacagtctgacggcctgtgcggttgtacgcccagtgctcagaagacaggtcgatcactgtgtcagtttgtgccagcagttcgagcgcatcaaccagagtgaacgcgttttcgtctggaaccatgttgtaatcaataccatcaacaaaacgctgtgacggatctacaacagcctgtgcaatcaggtcttttgcgttggagtagtcctgtttggtaaagcagttgtcatacgctttgatcagacggacatcacccagcttttgaagcactttccatgccagatcagggttcattgtgtgtagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgtgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcaggatgtcatcggtacgccagcagttatcataaccgtctgtcagaaagatcaggctgttcaggttgccgttttcggattgcagatcggtagcgatttccgcagccagattcaacggctcaacgaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccagatttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattcagcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacagacttcggtttttaacttatccatcagtgatgactctttgatgtgtgttcaaggttacggaagatgtttccatgttccagttgagttccgatcgggccgcattcatcggagtacgtgaattcatagataaacacgccgtcctgattgccgaacttcgtgttgtactcttcgtacaaccacattttgatcagagcgtctttctcttctgtttccagatcgtaccagtctcgcccgtcatacgcaagcgcaatttgagggtttgaacggtagcgggtttctgcgctttcttcggtttcccagtcatagcgtttatcgtcgtagaacgattcaaagctattacccagatgaccgcctaagtcacggtgaacatgattgaccacttcttccgctgttaacggaggattgtagtaaccgcagttcggaacgcaatcacccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttctccagtaaagccgtcgcattcagtgatacttacccagtcaaaaggtttagccatttcaatcgcacgttccagcgatacggtagaaccgaccaaatcactaaatgtatagtaatcttcgcttaaactttcaacagtataaattttcacgatactttaccttttgtttcagatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttgccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattaaatttcgcaccagcgccagtacatccgttaaacaggtcattaaaagtcatggtatgttccttttcagtttcgtttcggtaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaaacccttaccgtttgccttatttcgttccttacgctctctaaagcccttccatgcgttatctgacagggtgaacgaatcatcagcatcttcgaggatgtcgcctacgcgtgtaggggtacgcgggggaaccggaaacgaaaagaatacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagcagttcaggcacgttctcaaagaacaacacacggggctttttagcgcgtataatgcggaggatttcgaagaacaccgtaccgcgtacatcatcaaagcccagtttcaatccggctttactgaacgcctgacacgggaaccccgcgagcaggatatcatgatcaggtactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcgtcaatgtccgcccatagggttacattaacgtgtttgctatcttcgtacaactggcgaccatcaatcccgcccttgtaattgctttcggtacgttcagtaacttccagtcggaggctatcgcgcatgatctgaacaacagcctgttccagtgtaactgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttactcttcgagcgtaacctttttgaatcagggaatcacgccctgatttgctgggtacgtcattgaaatctaagtctagcactttagttgcgtatccgtaaagtttatacagaacatcaatttcagcgccggacaatttaggatacatcatttgtaataccccacaacatgatcgcggtatacgcgttcgatgaaatcgttccagaattcgcggtcaacttctttcggatatgttgaaatcgctgcaagccgttcgacttcgcccatgacttcttccagcttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaaagccttccagtcgatgccgttgttggcttctgcttgtcgtgcgcgttctccgtattcatcccagagtttgtacactgacttacgcatttcatcggctttgatcgtgaactggaatttacgccccagcacttcatagaagtcctgacaaccagatttcattgtcgtgtcggtaacgaatcggcagaactcgtttgtagggaaacgattcttgatgtcagacactttcacttcacgcgtatagcgtttcatatctggtgtgaattcctgaataccaccgatcgtttcggtttctttcagtacatcgacaacttcgcgcagtgcagccaggcgagaacctttcacaccatattttgcggcttgcttgcgaacataaccgaacaggccagttagttcagtggtgtaaaaacgccagcggttagcgcggatatactgccagatttcagagttagcgatcagcttgtcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtctttggggctttccccaggagaatatcgcgcgggtgcgggagaaagatccctttatagtctttatcgcttgtcggtgtgttcagtccatacaggtgagaaccaaacacggtttccattacagttttcaaaatttaacccccagggtttttgcgataccgcgcagttcagcggtagtgatttcaggaacaacaacagcgtgagaaccgaactcttttcggatcttttcactcagttcagcacgatactggatttctttgtatactgcttcgctgcgatacatataaaatccgccccagcccccactaccagaagtcaatccagtcttacgatcgactttctcgatgttccagcttttcaaatcagcgtctttatcagtggatgcatacagatattgacgcgcaacctttagaacgtgaaattcgcgagggtttgctgttttacgggtattgtataacctttcgccaggatcgtaaagggtatcacccactttcacatcagttaaatctttcggattcatttcattttccaacgttttgacttttcacagtagaacaccggaagacgggacagaactggcttcactacgtcttcccctgtgttcgtgttatgaaccacttcgattgtaagggattgcccttcggacggccttacaatgtccagttccaagatctcacgattaccctttgtattgatttccgctacgtagtaatcgtgtccattgatgtttacgacatcacccataataacgctaattgtttgaatcatgagtatgcaaacttaattttaacattcagtgaatccagcaggatcgcatcacgtccatcaatgatggtcaatcccatgtatttgttatcgtctgcgctcttgcgtgagtacatgcgacaaaccagagaaccatcttgtgcgatgtattcgacgtggtattcacggcgttctgacgtgaagatatccccaacaacaaccggacgatcgacgggttggcgtttagtcccttcgtaggacagtttgccgttgccgtctacggcgcattcaatgcccttatgtgtgacgctcgcaacagtaacaggctctacagttccaccgatcagcattgccggatctttggttcccagtttcatcaccagtgtttgacggatattattcgacatcggttctgtaacaaacacataaaccatatcgtttttatcacgcgcaacagattgcaaagtaaaattcttcgtacctactgaacccgtgtgtttgattcctacacgattaccgggttccagcgacatacgacattttacatcagagataccgctaagggttgctactttcatgatttaattccttcaaagtcttcattagatttccagtacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgtacgacctcatgtaagggcatccagaacgcctctaacgcatcgtcagaaccgcccataatgcggggcagactaccatcattgttaggctctaacttgatgtactgcgccacagtcggttttgagaagtgtacggaacgcttcggatgatcgaacaacatcgaattgcggattgaaccacggataaccttttcaggaactttgatccgcacctcttcgagcagttcacggatcgcacaatccaggaacgtttcatttgcgtttttgtgtccaccaggaagggctaacgcgtctttacctggtgcgaacttacgacgaattaccagcaggcgattgttacacacaaccacactatcacccgtgcagcagtttagcgcttctgggtatgggtagtttttgaatttctccaattcgctttcccatttctcgtattcgtagtacagtcgccaaaatgtatccgtcatcatccatgaattgatataactcacagtagacgaaggaacataacgagatagtttcttatcccatccattcttatgcaaaaagatggttggtcgcaaatcggtcgcagataaatctttcccgtcaaccttaactggatctaccggaacatgagtccatccaaacgctttcagccagtatgaatcagcatccttttcgtaaccatagatcgcgatgttgtcgcctttggtttcgtcgattgctgtacgaacagaggttttccatttttcttcgttgtaaagataatcaggaatatgagcaaatttaacacgacaaacatcttcgtatttgtattcagtcatcagccacgaaaagatcattctttcgcgttcgttcgctgtcagagggtttaaaacgttagggtaagcatatgctgaacccagaaggatgtaaacgatctttgcttctccgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattgtagtattctcgttcggagaaagcccccgctctgggggctttaaacccttatttacgagaatcgaaaatcactttaccagcgtaatcagaacccatgacagtttgaggtacaccgccctgatatttttccgcgatggtctgctgaacatcaagttctttccagcggatcatttctggggtgattgtgcgttgcagaatggcgttcgcttcggcttctttcttagccgcatacagacgggcatcagcatcacgttcgttagcttgtgcagcgttgctacgggcttctttgtcggctactgcctgaacaactgcctgttgagcgatttgctctttacgtgccagttctgctttctctgcgttcacctgttcttcacgaattttcgtgttttcaacctgcttcttgatcgcttccggcaggtcgatatcctgcaagaatacctgtttcacggtgtaaccgtaaggacgggcatactcttcaacttcctgctggatcgcgatctgtagctggctttgaacttctgcattatacagatcctgtgctttcggtacagatttaccgaactcacggacagttgacagaagtttttcagtcacatatttatccagcgcctgatcctgactacccgcattgatacggttgatcggggctttgctaccatcgaactgtaacatcacggtcatatccacagtggatttgaatttatcctgggacggaacctgcaatttgtcaaacttcattgcgatgtctttggtgttgaacacctcgaaatcagccagtggatttaccaggtggaaaccaggcagaacaggcttcggtgaaactttacccatgaaggtttgagtttttaccgtaccatcctgaacgatagtgtacgagttcggaaccagccacagtgcggcgattacgcccagagcgatcagagtggttttctttgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcactggtatttacgctgggagggatggtgtcaagatatacctgtagcgccgcattgatatagtaatcgaactctttggcgactactgacctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgattgaaagcatcgcggagatatcacgatgagctttgttaccgtcgcgattcaggtttttatcgaaccggatatatgcacaacctgatttgtgtttccagttggttgagtaccaacgaataccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccgcgcagttctcggatctcgtctgcccaggccagcaaccagtaagaaccctcgaacagattcaactgaaaatcagtacgcagaccgtaagccattacagggatttcgagttcatcaacaacgcgacatagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaactcgcataccgcgctctttgtaattgtgcgcgtccgtcaatagtcgcgcacttttgccagcgttcatggatgcatagtgataatacaatttagccattgacacgctccacaaacttaatatgattctggaatttgccctcaccttcatggtttttgcatgttttgtttgaacagtatatccaccaatcccactcgtcgtaagggggtttgtcaatgttcatgacgcaaatcaaaggaaaatgacaatcccgacaacgaactttttctataatgtgtgcgttagccaattgaaaaccatcctttacccatgagtttttcattatgtcgcgcaagatgctctttgatttccggtatctggatagcaatatcatactcttctttcgtcatagtatgatttgcgcaacccatacacccgcacacctgcgcgttacaccaacggagtgttccgtatgtcgcaatcaccttcattgctttagctttgattttgtcagtcatgattagctcgctccaccgctaccgcatcacgaacagcatcggtgatttcattttcaacgaaatccaggatatccgctgtaatatcgtcgatacaggattgattgtagttacgtgaatcaggatcatcatcttcggcataatcctgatacgcttcgcccagttgtttcagcttgtgttttaacagcttttgttcttgcggtctcatgataaatccgccttatgtggatcaaccgatggatcgaagtgaacaacgatgattggataatcacccgtacactcgtcgataatggcgctaatacgcaaccaatcgccaccagcaagccccgcaccgataagaggggtaatgataggcaatttttcaggaaacgcactggcgcgttctacggcgctcacaaagcatgatcggattgcgtcataatccacttgcgggccagtaccccagaatttaaactgagtgtaggcattgaagacaatctgaccttcttccgtcatgtagatggagttagtgcctaacttacgctggtctcctttcatcgtcaatgcatcaattttgaacgcaccagggattttgtgcttcacttctttagcaatacccgcacccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaacaataacacacattaagatataacctgtgttcatttaaattggtcatcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttccttatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcacgattattgcagagttcagccagtcgatcatcagcatgagcaaagccagcaaacagagtgagtaacagcgcaagttttttcatcgttttaccttagtatgaatcgttttcgataggggtataataatgggtttcgcagacataagcaagcactgatcgcaaactatcgctttcaaattctggcttttgattgcgtttcagactccaatccgtgaagcacatccagcgttcttctgcaacgtcaaaggctaaccagtacatattgaactgtgaacatgtatgttcgaagatatcgaacagcaatttgccaccgatcggcttcacatatggcttcacgcgttgaagcgatttcaggactgtttcgaggttactgcgatcctcattcatcgcgatacgaagaatatgctgattggtttctgggttatatccatcaatccccaaacccatatcctggaagaacttagtcgcatcatggaaaatctctcgtccgctgttcggtgaattgatgtaaaactccatgcgtttcttcggagtcatagcacggacgcgggaagcggttttgtgatcgatctcttctttgatgtctttgcgagcgttcagaagtttattcagcttttcctggtaaggtttcattaccgccctgatctcgtcgatacgttcatcaacgatcgctaactgctgttccggtgtcagtttagtttccatgttaagcccctacgcgcacaaagcgatcttcaattgcatcattaacacattcgtaaatgctaacgtcattcgggacgtgcttacgaataccaactttcacgatatccatgatctctttgttgctgccccacacgttcaggttgaagtaaacaccgccgctatgaattgtgctgttgccaacatcaagatacgtatcttgactttcgcagataaacagtttgcgtttttcttctccgtatgcgaagtagatactgaacgattccatacgatgacgatcgaccgtgatggtttccactttaacctttggatctttgttcagttcatctaacacaccctgaatgatgtgcagcatgttcggcttgatgataatcggatgactggtgataactcgatgtgatgtgctcataatttaatcctcaatagttggtacacacataataaaaagcccctgcgaaaatgcaagggctttttatcagataatgcgtttttcttctaacagcttcgcggtatggttaaccatgcgagcataatcacgggcttctttctttgaatacttgaaccccgcgttgtaactcgccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgagatcgtattcgttaccgatcctgaaagcgtactccaaaacctttttctgctttggtgtaatatcatccaattccttaacatagctgggggcattggctggcgctttcttcattactgttgcttgttgtagcggtaaagttgacttcacagaagggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagctttttctcgatgaattcagcaatgttatagtttgaaattgacgcaatcggatcgtacagcgctatgatttcatcaaacgatacccgaaccacatgtttaaagtgaacgctccagctagtcgtaaagatttcgctgttgttgaacccacaatcagggctgaacatggcgcgatattcgtaccctgtgtattctttcaaacggtttgcgctgtgcgcgttgctggtgatcaggaatttcccctggtgagtctcaaccacaaagaaatagcccagacgttctttattgtccagcatcgtttcaaacttacgattattttcttcgcgatcaacacgggtttcgatcatcttccagacctgttcatattcaggccaatcatgctcgacaacaaccgcttccaggggttctttgtgttgctcttttcggtagcgctcaactttacttagcaccgcagagagaagcagtttatcgctatcacttaacgcggaatcaatatccgcatgtttcatcacgacataacgttcttcacgtttcatactactacatccttatcacagaccggacaccgaatcacacgatacacatcacgaccgccagtgtaatcagttgataccttttctttgacatcctgcgcagtgtatgacagaacagcaccacaacgacaggcagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcaattagcgcaaacggtaattagctttggactgataataacgttgatcatgtatacctcacgaaaaaggggccgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaataatggattttatttcgtgattgctcaagttttgacattcatcaacaatcagaacagaacctttacccggatcaggatgcccgattgagcgcccacggaagtaatacaggctagggaactggacaacgtttttctccagcagcccttctacatatttgtcaacttccggttgatccttaaacagaatgttcaggctcgtaatacatggttctacagcaggacgcagtttttcgccaagagtaccaggtaagaacccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctggattgttttcatcagcttacgctttaacgcctgttcgtgcttaataggcaacacttcaagctgaaactctccagcattcaccacacgccctacaatctcaccacacgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaacccctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttatacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagggccgcgctgaattttccaatacacttttcccgtagatgtatcaacatctacataactcagaagagattcaagggattgaatctcttcctgtatggttcttgatgaataaccatgacttttcattacatacccaaacggataatatggatatatgggaacgggtgaagatgacttgaacgcatacacaaggtcagtgtttttgccagttcaaaccgttcgtcgatcgtcatgtcgcattcatcgaaaatcaggttgattgcctgatacttgatcgtttgtccacggaaaatggtattcagatcttgacgtttcgacagaatgaaagacgaatcagcgcccttatccattccatgttctgccgcagcacaaatacccatttgctttgtcggcgcaacgtagatattcagtgtccctttcgactgcttgatgatatcgaaagccgctttggttttacccgacatccggcccatatccagcgcagtttcgaagatagacacaccgccgcattcttgcccccaacgcccatcaacgattcgcgcaaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttttcgcgctgttgctctacggtgcgcagaccttcgcgtacaccaaaatcaacaggtgagagttccagagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttcaacactttcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatatattcctcacaattagttttcatatacagattatcataatctggtttgatgtcaacaaggtctatcgtttttatttgggaaagttaacgtgaacaggcgatcgtgtaatgcttcgatccgttcatacgcttgtttcaggatcgtcttatcttctgggttcgttgtctcgatgcagatcagttcgtccgagtcgatagcgatcacatcatccatcagtgaagcgaatacgttcacgtcagggtgtgtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactgacaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaatggggattagtgtcaacagttattcgaaacgaattgtgctatttttgaaaaacattccagagcacacagatcctttgatctgcttgccgttcacaccagttgcttcgaatccggttgagtaggtgtctttttcagaacatgcaaaccacttgtaacccgtgaactggatgttcgtataaccctgtgcttccaggatacgctgtgcttctttctcgtcagtacagcttgactgtaagaacacaacaacgacaaccataaaaatacacgcaacaattttccacataatttatactcttttaaggttagttttgctggcttcgatccagcctgaatagttcggggagaaatcctccgccacacccaaacaaacggtagtatgccctaatgggttcggtgtcgttactttactattgggattgatcggaagttcactagccccaacactggttgcaaacaccataccaccagttacgtaaatggtttgaatatgcccgtaagcgtcaccaggccacttgaaacggtattcagtgttccagaccttgacgttatacacgtcatattcatcgaacaggggatcattgccctttgtcgcttcgtaaagcgcaccgcgccattcaactaaatccgcttcgatatcacttacacaaaactcttcttttgcgctcagtttatcaagcatcatttcaatagtgcggatagccatgcttaattcacgatcgagtttcataatcaatttccttaacaacggttaaatgtttttccgttcttagtctgaataattccagcgcttcttctggggttcttccatcgtattggatagtatgaataccagatttaaaagtcaatggaacccataaaaatccaaatactcgtttctctaacttgtatgttctttcaggaacccatccaggcgtatgaacttcaactacccgaattttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcatcacccgaagcgatcagcagtttcagaaccatcaggctattgagagcctttggcgtgaattcctgttcgcttaacttcatcgcgtaccgttcgatgatcgcgattgacttcggatctttaatacgcccatctgtacggcgcgttttaaacgcgctcattaattcatcaactacggcggtacacttcatatgcttcatccttttcctgtgcagacatccgattatagcggatctcttcgcgctgttcaacttctctcacggcttcggctttcttttcagcggtcagtatgtgatgtactacagcgtttcggatttcccagagatattcaatcatctgcatatcttcaacggtatgatatcctttcgtatcacattcaaatacaatttcatcgcgttctgccattgccacctgtgcggtagaaggacaaataaccattccagagtatttttcaatcaacgattccagtgtacgcggttttactggaatgtcaaccgttaccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaggcgacacgtccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgttgacttgtttcaggcgcggatcattcttcacggcatcaaccacgttaaacgcatcatcataggttttcgagctaaccatgaagtgaaggttgatttgctgttgtccggcttctgtcaggttcgctactgagtcgaaagcgacatcaaagccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcggggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggtccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagttttcataatataattctcaaaatttaacatgggattggaagacagcgcgagctagtttttcgctatcgaacgggattgatgttccctggcctttgctgtcaatgttaacgcgccagaactcactcgaaccgtttttggtggagtaatgcatcagcgttaccgttttattcttttccaggaaggtgcgtttgtcaatctctgttttgatttcgtgttgcatcattttacactccgtttcagtttacgttcgtcagccagttcttttttgtacgttttgatgtacttcccgttaaggatgcgaagctgttggaaaactttattacacaaagcacgtttcgctttgtattccggcgtattacggattgattcgatcgtcatacccatttcgtttttagggtacgcgctcaactccctgccgatctctctgtgccagttgcttaactgatcacgctgtgctttatactcttcaaaagttaacattataactggtctccgtaatctttcgctgcatcttcgggggttgcatccagtcggtaaagctcaacggctaacggactgggtttgatttcgcggttcaggatctcactgataccgcgaaggaattcaatataaggacggaatctcatttgatacgtaccgcgttaaaagcctggttgcgcagttcataagcctgttcaagctgttcagtagtgaacagagggctatcggtattagtggtgaaactacaaatggttttgttgtcggcgttgacttcttcaacaacgatttcgtaaccccagatcccgctgtactcacatttcacgttacggtacttgatgtaaaccgcagcaacatcttcttttttgtagttcttgcttttgtagatgatttccatgatttcctccttcgtttcgatgtgtgtacaataacagttcagggttatcgagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaacgcatcttcaactttttccagtttttctgcgttgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtgatcaacgtgtatcttacacatcaaaaacttctccccgcacttgtcgcatgttgcatacatatcgccatgtatacgcccgatcccatcggttacagaatgatgcatccaagcgtaaggagttccccgcatccatccggtagcaacatgcttgcatttacgttttcgtccgaacatatcaccacccgttaggattgcggaaatgggtttgccagtagcgcagttgttcgcggttcatgttttgggtatcaatcaccatactctgaatcatctgcaacatcatgcgggtttgattgacatcctccaggctcgctatacgctgttttaaggcttcgttctctttctccaactcaaccatacggttgtatgcgttgacgcgctccagcggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgattgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgacccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcgttagaaacttcacaaccaactacagcggcaatgtttttgttcatgttcatgatgttttcctttctctgtttcgtttcgatgtgtgtaatataacaaagcccctgcattgctgcaagggcttttttcactttaatcgaatttttctggcaattgatctacaattacctgagtttgatggatttcttcactcaatttatcgcggtaatgaaccagttcacgggttctggatgctgaatagctaatgattttatcagcggtagcggtgtaaccgtaaccagcacatgcgatttccagttttgcgttatcgccattcggtacgcggatatgagcataggtcagcaagtttttaaccgcttgtaacagttcatgatcttctttaccgatgataaactggtttggttctactgaatcaacattcagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcctaatttcaccttcgtagactttgataatcgtcgtcaggcgttgtttgccgtcgatcacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccataatcgcgtgatcgcgactgcgaaaagttaactgatcgcggatacggttatgaaccggaatatcatctttagacatgattcaccacccaacccaacaaaccagtattgatagccgcaacggtaaggcaaatcaccgccaacacccgcgcgttatgaactttggttttcagttctgcgatctcctgatccttttcactttcgaactcgtcgcgggttccatagtaaccaggatcagcagcggttgcgatacgcactttgtctgtttcgaataatgttgattttccatgatccggcacaaccacacccagaataccatcacggtcggtattgacaattccgtgcgttccggctttggcaaacttaccatccttaacggttactacacgatcgccagctttgtaagtcataatatatcactctttcacgttttgttgtaggaactctaacagctttccttcggcctgtaaagcataaagtttattcagctttgcgatattttcaaagtctgatttttcgctgaacgaccagaccccatcatcggaaaccagcgcaccgattgatacgccagtttcaggatcacgcgtcaacgccagccccaggggatgcaggatatctttattgattttccaaatcagccccaattgagataaggtgttgaaatcaacgtgactcatttaggcaatgccccgaaagacagcagccccatacgatgatcgttatctgattcaccagtgctgaattcaaattcttcaccgctgatactgatagcgcggaaaccgtctttcaggtatggcaacagatacagagggatcagcatcatgtttgaatcgtcgctccacttacggaagcccagatttttcatttcttccagcgtcaaatcattcggatcgacgggttcgaaatcaggggaagcgtaaaggcgtccaggcagatcgcgaatatttttcacggtgaatgaatcaccccatgactgatacgcgataggttcagcggcgcgggttgcggtagccagaaggatcatttgacagatttgaaaagttgttgctttcatgatgtatatcccacaagtttagatagaaggtgtcccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgcaccctgaacttacgatcgtatgctgccagcgctttatctgctgcatcaacagcctgtgtgtgtttgttagcggagttctcgctaaacacttcgcggtaaatgctaacccagagagatcggcgggtatgttcgctttcttcgttgacacgagaagccgcaaaagcgttatgctctttgatcagttgtgcgaattcagcataatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttattcactttttccataatgttcttcgtagtcatcgcattcagggagataagtttcgcagaacatgcacagcgtgaagaaagtaggctggcgaatcccgatattatcaggtaagtacatccagaacgtgttagcaaacacgatgaacgttttcaggttttcaacggttacggtactgacaccatcataaccggattgagcaattgcgcgttccaggggaacagggtattgctcgcagtaatcgacgtaatgatcgcttgttacaagcgcattagccgcttttacgagatcggtaattttcatgctcttacatattccactttgacaggttttgcgataaggcgttctttggtgaagccttgcccgttacagatatcacaggtaacgttgaaatcttccatctgatcaacccagccagaatccggcaagccagaaggatacgtgttgacacgcacaacttcgaaccctttaccctcgcatttcgggcatttgtgcgggtactgggatttaaccatactcagcagttgccccagcgtcgttgaacgatcgaagcgttcgactagtgccattacatcagcaatacgaatcgaaccagcatcaataacggtatacaggtttttcggtacatttgagcgcatagtatatttctcacttaaaaaattttttgatgaaagagaggaacaagccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatatacagttgaggtggacaatcttttgaagcaatcaggcgatccaggcgtgacataacgcgtctgtagccgtcatactcgaacttgattttgggtgcgatgtagtttacatggatcgcgtttcgcgtgttcaggctcaacgtgtactcagggataacggttcggaatcgtacagcaatcactggcttttcgtgagcaacagaatcatccatgttttcgaacatctggacggtgaacgcacaggcaaacactttgccattaatccggcgatacgcaataacttcctgcataccttcgtttttcgctttcaccgcgtaatgcagaacgttacacgaataatgtttagcgagactattaagaatttcactgtagaccgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccacttatcgccgcgatgttcgatgtgctccgtgatgtcttcgactttcttatccagatccagaggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacacccacgatcgtattaccgtatttcgtttcccacttctacacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaagggggctttcgccccccagtggttaaacgcctaagcgttaattatgcttttgatgcatcaatcgcttcatcgtcgccagcggtttctgctgttgctggcagaagtgctttgatcgcgccgaccagggcatcaggggatacaccctgcgaaccgtcgatttccagaagactgcaaatttggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcactcaagccaggtgtcaaaccttgctccgttgaatgattatcttcaataccagtttcacgttcaaggaacacaaagcgagtcccgaacttgctcaggtatttatattcgtgcggttgacgcacatcggtaatgataaagtgatccgcataggatttcaacattttttgaatagcaatcgaagtccagatagacggatctattttacaaacaatatcagtcccgaacacctgcatcaaacgacgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtattatcatgatgttccatagaacgtttcaggatagctttgatttcgtcggctaacgcgataacttcaacattgcggaagttatgcacaaccatttgagcaacggtatctttacccgttcgctttttaccacaaataccataaatcatttttgcgttttccgtggagtcggcacgatcacctttccgtcgatttcaatttccatgtgtgcaaagttgaacatcgtcatacaggatacggcttcatccgaatcattagtatacataagctcaagctctccgaggttggagggccaagcgccatagaagcgaaatgtcgctacagtttttgactgcgagttatccaggatatgcaaggccattgcctgttgtggttcactccagcgaacagactcgaaggtattgaaatctacagtaccgagcatccaaaggtaaaccccaagatacgatcgcagttcttcatcaacagcaaaacgaatagtcagtggatcgaactccattgcagatccagggatcttccctcgaatcattgggttcagtgggacatccgtaattggaatgttgatagaaggtagtgtaacaccctgaacttgtagtttcaacccttttacataatcattgtcaggaatatctaacatgaagttagtaggtgaaatctggttcaggatcatagcagttgtattcatgatgatctccattttatagatatttaggttagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttttagttgatctattcaataaataggtatatcatacctatactttcaaaagagattgaaaacatgaaatcattcaaagaactactttctgaatctgttcagaacaaaaaatttgctaaaaccgttgaacttgttgatcgcaacggtgttgctccatcaaaaggtcagatcggtttcctgcatttcgcacacggtgctgattacgatgtttatgcgccggattcccacgatctcgcttacttcggtaaaggtgttgtccgcctgaaaggtaaaaccactggaaaaacccaggcagcgtatattgactgggcgaaaggcactgtttcattctacagcggtgatcctgctgatgacctgaaatttgacaagccgctgaaattcaaaggcgcttccctgtacaaagaagccgaagaaaatctggatctgtataatcagttggcggaagatttcgaaattgatctgcctctggatgaagcactggtgaaaggaaaggtgtacaagctcccatgcaacgatatgtgtttgttgtataccggacgtaccaaaaccaaagctacaggcgaatacgccgtgtttacggttgtagatgcctctggtaagcctcgtctggtatcgggtaaacgctttacccaggaatacaaaggtgatgttctgtctaaactggttctagctgaatcagaagatttgaacgaagccgctaaaggtattcgcgaaaaagttattgctgtgttggtgaaacgtgggtttaacgaaaaagacgcagaaaagatggttgataaaaacctgaaagatgcgatgaaggttcgacctggcgcaacccctggcaaactcgcggaaatcgtgagtatcctgtaaaaataaagccccttcctttcggttggggcttttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcagataggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtaaagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatccttctgacgtttcgcagcggttacaccaacagtcattttcttcaaactgtttcggaaatcgtttacgatatcaaccgcgtgttttttgcgatagtcgttacgtttgcgtcgggcttcggtttctgctgtacggcgttcgatttcatcatcaatctgctgcttgtagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaagctcataattccctccgtttagggtatttattgccctttccatccgaacacacgtttcaacgtgtcctctgtgatgatcttgaactcccagcccttttgttttgctgctgcattcgcggctttccatttgtcaatgtttacagcataagtatacaacgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttgttctcattctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaattccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaaaccggacacccagaaaggcttctgtgacccgtttggtgagtatcctcgttatgtaggtaacgatgtcaacgtactggctcgtggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggagaaaacccgtgatactgcgaagatcaatgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatacccgcgtaatgtttgaagaacctaaatcggcatacaacgctgaatatccatacaacatggtattcgaatcccgttctggacacattcaggaattcgacgacaccccaggctttgaacgttacaaccgtgttcacccagcaggatcatacgaagaaattcgtcctgatggaacccgtgtcgttaaaatcgttggtgatgattatcaaatcgtcatgcaaggccgtaaattaaacgtcaagggtaatttgcaggttgttatcgaaggtgatgcgttcatttacaatatgggtaacgttcaacagaccgttgatggtaacgtgaccgagttcgtgcgcggtaacgtgaatcaaaccgttgaaggtgaatatttggggctgattaaaggcaacgcagaattaaccgttgaaaaagatgtaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcgggcagaaaagcgatccgcttccggtggtgaactctccaaacgtaccaacgaatccagacggaaccccaggggtttctactgacattctggttacgaagattggttactatttcgccagtcaagcggatattgatgcctatatcgcatctatcggggctactaagctcgcgggtaatgactggtacggggctgatctgtcaaaagcaaacttgttcaagaaccctggcgaactcgcgatgtacaaggtggaaaactccggtggttacttgctgacttctggtccccgttgcgatcagcgaatccgacaggtatacaatcagactacaggcgcgtttaccagcattgattattactggaatggtaatcgtattgcgtacatgaaacacgacgaatcccccgcgcaccagtgcaaatatacagggatgtcagtaaacacgaacgcagataccagcattcctccggttcctcctgctctcccgtcaacgtatggggcgctaccgagtgaagccagattgttttctgctcgctctggattgggctgtattccggcgaccgtagggttcccgtatacgaatatcagtgatgctatgctgtctgcgtggaacgagactcgtaaaacgttcaagctggcttttgatatgctgacgggtacgattaagaacggtaagggcattgcgacgatgtttgacgggctttcgatcgggatggaagaaatcacagcgggtgctctggcattgtcacagcaagcatggcaaaccgcaatgaaggtattccgacagatcattagctctgcgtttaacatcgtgggcggggcgtgggatttgatcaagaatttcctcccgactgttgcgatcatgggtgttgcgatcaacatttacgatctggtgtttggtgatagttcggttcaatccctgaaagattctttccaagctctgattgattccggcgcacagacgtatgaaagcgtcataaacgcaatatacggggctataggcagttcttacaactacgccgttgaatatgtcaaggctggcgctcgcgaccttgtagacgcttgtagcgcgttatttgactggtgtttgactatgttccaaaacggttgcgttgctttggtagatttgtacgggcgcatgatgcagatctggtcaatgcctccagaaacaccaaacccgctttggtctgcggtgctggctatccgtaacatcatgaaacagattaaacctcttgatgtgattctgggcggtaacttcccagggtttacagcaatggatctgtatcagcaagcacaagcgaaagtgaaagcgttcattgatgcatcctatgcgcagatctccgcactgtatgatcagggacaagaattattcaaaaccctgaaagcacagacacaggaaagggattcgattaaacgtaagttcgatcagtacctaaactggatgtgggaacctgtaaaggaagcaacgactgctgcttatcaggctgcacttgatgccgctaacgctgctgtgaatgcgactaaggccgcatatgagggaatcaaagcacagattgctaatctgcaaaatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccgcgcggcacgaaattcatcggtacagtgaaagaaacaaacagtttcccgttcgtcgtatctgatgacgtggtgatcgttcgtgacaaagacaataactatgtttcgatgctgaacatcgtacaggggcgtttagtccgtacagaagtcatctatgatggttctacgattctggttcgagatccgaacatcgaccgtagccaggttcgcgttactgtcaacggtgctcaatgggatgactggacaaacgaaagtatcgtaaacgcaacaggcgcatcaacaattttttacatgcgtgaaactgtggatggacataccgaagtttactttggtgaaggtgaaaccagccaacaggtcgcaggtggtgctctgactgcggattacatcgggggcttgaaacctgcaaacggttcgactattgtaattgaatatatttcaaccaatggcgaagaagccaatggtgcggaaaactttgtttatgtggatacattgacaaatatcagcattacaagtattgttgaaaacccgactgattcagcggactatgtaggcgctgatggtggtggtgaaccggaagatatcgaacgtattcgtgaactcgcgcctattatgcgtgagacacagcgccgttgtgttactgcatcggattatgaatcgttcctgtctcaccgtttcggttctgttattcaggcggttcagtgctttactgataaagaaaaacctggctatgcgttcatcgctgttaaaccgaaatcagggttgcgcttaacctctgttcaaaaagaggacatgcaaaactatctggcgaagtataacctggcgactattacgccgtcgatccttgacccgaactacctgtatattgtacaaagcgttaaagtaacgtatgatatcagtaagttgatcgagtctgaggaatggttgcgtggtcaagtaatcaatgaaattgacagatactacacagataacgttgaaattttcaacaaatctttcagtaaatccaagatgttgacttatgttgataacgcggacgtgtcgatcattggttcttctgcgactattcagctattgcgtgaactggataactattacagcgccccgatgtctggtattcacttcttaaaccaggtgaaatcacgttctgttgtttcgaatgggttcaagtacacaaatgctgctggtgattcgtatgatgtgcgctatgcgtcaacagatatgaacaccacgaccggactcgcgaaaatggttatcgggccattcaaaaacggtgatatcggtatcgcagcctatacagaaaacgattttgataaatatcctggagtaaccgatcgtgataaatattacgaagtcggctatgtggaacattttaatgatttcattagtttcgatcttggtgtcctgaacgttccatccgagcgattcagcgctgcttacatcgaactgactggtacacctctggaagagaacattttcacccgtgatggttctctgattgtatttgaaaacgatctacgtcctcaatatacaacgttgacgatgaatccaatcagtcaataatttacaacccctgtcatttggcaggggttttttgtttgctaaatatgggatataagtaaaacgcaaatttggagaaacatatgattaaagcgccgtcaattaccagtttgcgcgttgataaactggctgctaacttcgtttatttgaagtgggatagcgtcggcatggatttttactatgtcgtggaaatggcagaaactcgcggggtaggtggtgtaactattccagatgaagatttaacctggttccagttgggttatgcttatgtaaacgaatggttttcttccgatgttcagcccaacaatttttacaagttccgcgtcatggttacgcacaagggctttgaaccgtctgactgggtttatacagatgaactctggacgtttacccttaacgcttacgcatattcaaccatgcgtgaatttacgccaagcgatgcattcataaacgagaaattcgcaaaaaataatcagaactacgttaactttaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgatgtggactcatacaacacatttgctaaactgcctggtaacgtatcgaaatatgcagaagcaatggcatgttccgatgactggctctatgtggttgctaaaaacgttgtgcgtcgtatcgcactgaaacagacaccgatcgacaccgatccgagttctccaacgttcggagaaaagattttcgatactgacagctatacagttgtccctggaaatgataagatcgttgtcaagaaaatggatgtgatggatggtattctctatgcactcgtaacgggtgaagtgaaaaccgctctgcaagatcctacaaaacccgctaacgtggttccgtccgctgctgctggtgtgtatcaatggcaagaaaacacgaaaacctttgtgcgcctgtatgggaacaccgaggaagaacgtttttatatccagcatgaatacaccaatatgtcaacgaacggcacggagatttttatttccgtagcgaactacaaatatccaggcacacttcccgatcctgaattattgatcgagaaccctgcactggttggtgctgtaaaatatgatttgcgtcctggctatactgccagccttgcgattaactttgcgacgattcgcgctcatatcgacgacccgactgtttggaaatttggtgcgcaggaatactacaacgaggcgaactatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggtgtgttgttgtataagagttcaggcgaaatcattgggttctttgaattgagttatcgcgcccgtgacagcttaactattttctggaaaccagataacacgttgctgattgccgatctgattcagcaggaacgcgaaaaaccgtatacaccggatctgtcacctggtttgattgacccagatttaagccatatgattacgcgctttgcgcctcaaagctatctggatcagcaatattttgagaagttcggtgaatattatttgcagttcgtttcgctgggtgaaaacacctactataacaaactgctgaacctgatcaggaacaaatatccgcgtgagaagaacagcgtagaatatctgtggtcggaagtaaaccgccgtaatatctacctggataaaacgaagcgcgatcaagtggtacgtttctttgaatctcgttgcagtgatttttactcaacgaaaggcatcgaagcaagctataaattcctgttcaaattgctgtataacgaagatgtaaccgtagaaatcgaaagttcgaacactctggaatatgatattctggttcagtcaacgaatattagtcaggacatcgtaggccggacgatttacacaccaactgcaagagcaaacgtgacgtatatcgaacgccagtatgatgacggtcaattacgctggtcaatgactctgcataacgtgatcgggaacttccttgaagggcaggttgtcaagtctgaaaagactaacttcacgggaactattctgcgcggtgtgcgtggtaagcaaatggcgaacaactcgatcgactatttcaaccgtgggcgttcatactatgtgatgaaaattcgttcgaatctgccagcgtcacgatataaggatgacgttttacgattcgtgcatccggtaggctttggttttatcgggatcaccatgttaacggtgttcattaactccggtttgtctatgacacatagcgaaacgatcattgatattcttcgaaactatcgcttcgatagcggttatccgaagtattggcctgatcgtgtagcccgtctggacggtaacggaaaccagacatttgacctcgtaacaggcgaagcattatacgaaccacaccctaaagcggggcaaccgttcgatgttccaccagaatatgacgttgaagaacaaccgctgaatggtgtattaccttccgcgcgtcgatttgatcaaagtcctctgttcgatagttctgcggttaaatactctcagttccgtaacttagtggaaaaacgattgaaagacgacgcgggtaatcctcgcgatccgaatccaccgactcagagaaaggtagcataatggctcaacaaaacatctaccgtgcggttgtaactggtaagttccgcacggaaaacatgatgaactttcgcgaaatgatcggggatgaccccgatcataactcgatctatatgtcgatcgggcgtactgaacaatgggcggataacgaatccgatcctgaattcgcgcccccttatcctaacgatgatacagatggtatcgttgatatgtggacgcatatgatcgggatgacgaaagtaccaggcgaaatgattgatgcaatcgttccgcgtaaagactggggcgatactcgatatcctaacccaaaaatcttttacattaatgacatcgtggtagtaaactccgctccttataaccgtactgattacggtaaaggatggatggtgtatcgcgttgtggacgttcctgatattggttcttgctcaatctccagtatcacgggtaaagttgaatgtgtgcgcattggtggcatttggacaccgacccacgaatcggtcgaacctccacgcggagaagcgaacggtatcgacatgggtgacggctatatctgggaatatctctacacgatcccgcctgatgtggttattaaccgatgcacgaacgaacatatcgttgttccgttcccgaatgaactcgaagaagatccggttcgctggggttatgacaacgtgatcaagtggtatccagatatgtatgatttggtgttccgaatgaaggttcactcaatgcgattccgtgcgtacatggattccctgttcttcccgcaagcatctttacctggcaaccgtggattccgtcaggttagtgtaattgtaaacccgttactgaaaaaggcgcaaccgaccgatccagaagtaaaagcaacggggcagtattacacgaaagaacagcttgaacttgactcagggcaaatgatctacatggaaaaccgtcaaccgattattcgttctcctgatcagaccgaagaagtcagtattattttcgaattctaaggaaaaccataatggcatatcaaactggtaaaaaattaattgacgtggggcagatcggcaacccgtcaactggtgacccgctgtatgacggcggtgttaaacttaacgaaatcatcaccaacatgtacaacgcgtttggtgatgtgcgtttgttgactgcgaatgatggtgtgggtacaatgctgctccacgcgaccggatatttccagaaactaccacgaacctattattcaggcaacccgatcgaactgggttcattgcatgatatggatacctcaacaggcccgattacggtcgtgcttccatcgggtaaacccggtgaagggttctatttcataaatagtaacggtagcatttctgttgatcgtcctgttgtattccgtccgcaagttggcgatggtatcaaaggggttcaggatcagctttacataacctctccatatactcagattaaaatctggtgtgtgaagaaagaaggttctgtttctacatgggattattctgttgaatcaatgtttggttcaaagacaatgcctgttgatactaccaaactcattttgaaagcatcaccaacggctattcctatgtttggatatagcgaatttagcggcgctaaacttctcgtatacgcggaaaacatgacaggcacagtcaataaaacagcagaaattctgcttgccgtcgatcgtgtggctaagggcgtttattcaaccgaatacgcagttcttaaaaatacagaagatgaaatgtatacgcttaattttactgttggcgctggtgatgttgtttacgcaaacgtgcaatcgaaaaccgaagatcgtattaaattctcgatcaaagcggttgacaccatcaaatcagggatcgcagcatgaaacaagaaattattatcggtaacgtggttgacgatggcgcaggtgattatctgcgccgtggtggtcagaagactaacgccaactttaccgaattgtatgataagctgggtgatgggagtatcccgcatccagcgggtgcgtggaaaacgcataccgcgcctacgctatcccctatctttggtgattcatgggcgctgaacacaagcaacaaccgtattacggtaaaccttcctaaaggcagcgtaagcgattataacaaggttattcgtttacgtgacgtatggggtaagtgggcggcaaacaacgtccgtatcgtccctgcaagcggagataccatcaaaggttcaccgaactacaaagaactgtacaaagatttgatggatgtcgaactggtttattgttctcctggtcgttgggaatatgttgaaaacaaacaggttgacaaaatcacaacttcggatctggctactgtagcgaaagaaacctatatcgcgactcagggacaaactgacttcctgaatgtgtttggccctggtaactcttacaacgtccgcgcactggaagtttactatcgtggtaacttgctgtacatcgacgacaagaacgggtttaatgcatcaaacagcgattacggttcacctggtgcgagcgccggacaactgatcgaactggatggtgtaaacatacgtcttaaaaacccgtgtaacgctggtgatacgcttcaattcgttacctatctggatggtattgccgcatggcgagcgacgtatgaagcgcataccatgcgcgtatataacacgggtgacaccgaacaggtaagtatccctggtgaaatttgggttggcgatctgccgaataaactcacattcaccactgctgaatttggtatcagtccgcgaattctggttaacccgaactcgttcgaactgctgctgaacggtcgacagcttgttaaagcaggtgatgcggatctcccgacatttatttgtgagggcgcagaaggttatgacgaagatagctgtattgcaaactccggtttgtgggttccttctggtcaggattacagtctgatttttgttgattccgaggttactggtattaagtttgctcaacctctggaaactcgcgatgtggtaactattcgctggttcaacaatgatatcggcactgtaatggaatgggacggtgtaggcggtattaaagaacacaccgataagatttatctgaataacgaagaagaagtaacgctggttaatcagattgaatacaccgattataacaacccgactcagaaaaccgcgcgaaaagtcgcagaaccgtttagtggtcgtcttctggatttgcaagcgttctttgacgttattcacccaatcgggacaatctacgaaaacgcgcacaacgatgctaacccaggcgattatatgggctttggtatctggacacgttatgcggaaggaatgttccttgctggatggactaccgacgaagcagatagtgatttcggtttgaacaacaacgatctggatggttcaggtcaaccaactcacacttctggtggtactggtggcgaacgtggttatgaaattaaaccgattaacgttcctgaaatccattcaaccgataaggtgctgattaaggatgacaacgggatcattattatcggtggttgtcaggttgatccagatgcaacagggccaggttacactaaataccgtgaggatgtattaaaagtaaatcagggtaacactaccccagataaactaaaaacgctcccgccgtatattactgttcaccgctggataagggtagcataaatgacacagtttatttccaaaacaagggagggggcgaaagtcccttcccgcgaagcagattttttgcaatatgaaatgggttcgaaattaccgctgattggcggtaaacgtaccattggcggcgcaaacgtcgatcaacttcgaaaaggggtagaataccccaacgtacaatcagcaattgatgacttatattctctgtctgaacaaatccctattaatggggtagtaacaatggcagaagataattcaccgtctgcggttcagcaggtcgaaagcattacgtttgatggtactgttcagaacccagatccagatcagacgaaagcgactgttcatgtttacgggttcccgtttgtttttgacaacacaacgaacgcatcaaccgtatgcgaaaccgtttataacaaatttactgaatttgtgaacgatgaaaaatatttcgatctggtaactcgaaagggtttaaatggggagatcctagaagttcgttttattgacgcggttccgcatcctgtaacgaacacttccgaaaatgggatcagtatggtaggcacgatcgacgtacaggctaaatctggttatggtacatggtcgaaattaggccaagcagatcttccggttactcctgctgttacggtttactatttcaagcgtattgcataaggacaataaatgaacaacacaattaaccacgtaagcgataaatccgtttacgtgacatttgatcctgctggtacgcaatggcctagcacgtacacgaatgttcagcaagcgcttgcatctatcggatcatgggcgcgtactgatgttggcttgcctaatgccgcgcctggtgtgcgtggtattgctgctattgctacacaggaaatgattgatgcaggtacagacacacagacgatcgtaactccggctctgctggaataccgtctacaaaaccctcatgcatcacaaaccgtatgggggtacacccgttacgcaactgatgcagaatcagtaaccgtaacgaacgatctggtttcattaacaccgcgttcattgaactatgtgtttaacacccgtcagtcaaaagaaaacgtctggggttctgcaaaactgtcaaccactgcacaggcaacgtctggtactgatgacacgaccgcaatgactccgcttaaagtgaagcaagcaattgctgctatggttccggtacagtcaaacgcaactgaaagtaatttcggtttggtacagttggcaacagttgccgaagtccgcgcaggtactatccgtgacggtttcgcaatttcaccatacacgtttattcgtctgactgcaacagaaaccgatttaggcttactccgtatcgctacacaggaggaagtaaacgcgggtactgataacacaaaagcaattactccgcaaaaacttgctgctgtgaagggttctggctctgcatttggtttggttaaattatcaacagatgtcaacaccggattagcgaataccgcgttgtctgctggcgctaacgtagttccaagcaacagaaacagtgctatcactggcggtgcgctgtatcagggttctattgttgctgacaataaataccagacacaaagcgacgttgaagtaaatattccgatcggttgtatgatgctatctgcatttaactccgactatggaaatatttttatctgtaacggacgcgcaatgaaccgcaacacataccctgttctgttttcccgtatcgggtatacatacggcggtgctggggatattttcaacctcccagatatgcgcggtgttgctgctcgcggtttcgatgctggacgtggattagatcctggacgtggtttcggtacttaccaggatgatatgtttaaatcccacgaacaccagttacagatgatctatcgtaatggtggtaatcttccgtcatccgaagcaatatacgaattgaaaaattcagaaaagaacgaccagttaattatgcaactgaatccagcatacactaaagctatggcaactggcggaaacgaaacgcgaatgaaaaacgttgcagtcaactatgtaattcgagtacgataaaggggttaatccatgatttcaaaacttaacccgttaccaaagatcccgtttgttgatggtgtccctacggacaccacacaaacccagatcaattggattgttaacggcgaaactctcgatggtgctaaaaccaaaaccactaacgagggttctttaaacagatgcggtgttctggttcaaaagaacgcggtacaattagaagcaaacacaactacccagacatcaaaaatcaacgaagttatcgatcaggttaacctcattaccgaaaacctcgcgacaatctccgatgaaagcgtgatcgacaaactggataaagttgtcgctgatgttgacgtgctgaaagtagatatgtcttctgtacaggcaactacagcaagccacactctgaaaattcaggatatcgaaaaggaaattggtgtatgggatgcaacaaccgatcctaaacatcgcacgattcgaaaagatatcattttcctgaaaggtgaactgggggcgtatccaggcttcaacgaagatggtgatgttgatccgtcctctactggctccggcgtgaaatacaaggtaatggcgaacgctcaggcggtatccatccacgaagcacgtattactaagctggaagatgactgggtaaactcagatgtaggtcaattgactgatgaagttacggatctgcgtaacgaaatggggccgaagcatttagcaacgtttgaatcagtttatgttcgattgaaccatatcggtgacgatatcactggcattaacaccgaactgtcaaacatcaacacgtatatcgggcgcacgggtacaggcggatcaggtagtattgattcacgcatgaaagcggcagaaacgaacatcgttactctgcaaacccagatgaatgatccggttgttggtgttctgcctcgcgtaatccttctggaaagcgctgttggtaactcgcaggttccgggtagtatccgttacgatatcagcacaatgaaacgtagcattagcgatctgaatatgatcgttggtgaaacaagtgatgatggtctgcgcggtgaaatggcacaggttatgaccgatatcggtactgactcccagccaacaagcatcaaaggccgtctgcttaatgtggaaaacacacagcgagacgatcaccaggcactgattgatgttaccgcaattgtgggtaatacgtcaactggacttgttgcggctaatatcgcgatgggtaaagctgtttatggtgacgcaaccagttctgatccattcctcaaagatggtattcagaaaacggctcgcgacaacaaaacagcaatcggtgtgaaaactgctggctctgaaacaggtatctataagctgatcgctgatctgactactcgcgttgctgctctcgaagctgctggcggtggcggtaatgttgaacaacgtctggatgatctggaacagaataaagcctctcaccaggatgttgctgacgctctggttccgtatattacggaagttgaagcggataccaaatacgaagcgaagaaaattccattgtcatttactcaaaaccttgtcggtcgtaccgattatatcgagggtgatgatatttctttatctgttaccgttacgggtggtaaactgccttacgtgtatcagtggaagaaagggactgaaaatatcggaactgattcaccaagtgtaatgatccagaacatcactacaagtgattccgctgtatataaagttgtcgtaactgacgctgaaaataccgtgattacttctgatgaacttgacattaccgtatatccgattcctaagttcgacacaaacttgagtgatgtttctgtcgttgatggtgatcctctgaatctggaagttgtgtttagcggcggtaaaactccatacacctatgtatggcataaagacggatctgtattaactggtcaaactggttcttctatcgtcaagtctgctgcaaccagcgcagatgcgggtgattactatgtaaccgtaactgacgcgatgaacagtaccaacgattcaacaaccgcgactgtgactgtaactactcgtccggctctggcgtttacaacggatcttccggcaacgaagagttacacaacaggcgataatatggatttagccgttgttgttactggtggcaaaacaccatatacatacaaatggtttaaagatacggttgaagttactggggaaactggcgcaagcctggctacagtagcagaagcgggagtatataaagttgaagtgactgatgcactctcaaccaaaattacctctgctgaatgtactgtgacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtattcgacttgagcaaagaacacatcttcgcgatcacgaaggtattgcgcacaaacatgggttcattgaccacaatggacgggacagcggtttatccgtggtttaccgatttcctaatggggcttactggtggttctctgggcggtcgatgtgcatcaagcgtgtacggtatgaacgcatacggtgcggatatgggatactttacccagatgatgtcctatcaacgctcaatgcaagacctgctggctccactgcctgattactggttcaacgatgatactggtcagttctgcgcatgggggcaggtgaacaaaggcgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaagttccaggggatgcaattgcctggtggtgttgctccagatggtacgcgactgatccaggaagcggaaaccaaactgcaaagtctgcgcgatgaactaatttcgatgtctgacgcagtaccgatcattatggtgtagggggaataatgcaaaactgggatgaaagtttattcgctcagttgtctacgggggaaggggttgatcgtaacttaaaggatcaggtcactaacccgtatgtaaactggtacaaatacaacccgacacaacagctacatgattcattgacagcagaatcaatccagatgaaatcgcctgatatgtattacgtccggcgcgactttgtgaatattgataagattcttggagaagaccgagaatctaaatttacgaagtcatggaaaattgctgcttatattgaatcgtatgccaactatgaagggcaacgagatttctttagtaaatttgggttgagttcaaacgatgaaatgacactggtaattaaccctcgtttgttcgcacatcaaactgatggtggtattcctgttctgggggatttggtttatttcccgatggacaatagcttgtttgaaattacgtgggtagaagccgatccgttctatcagttcggtgatcgtcctcaacgcaaaatcaaccttgcgaaattcatttacacgggtgaagaactggctcctgaattgcagcgaaatgaaggaatccatatcgaacctgatgcagaactggatctcgaaccgattcgaaatcttgacggtctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctataccctcttcaaagagaattttatgatatacacaaaacttaaagaatggttgcctcatgatctatacgttgagtatgttgatatcataaaggcttctccaaaaactgaacacacagaaaaacatcatatattaccacgttctttatttcctgaattcgaacacgaaccagaaaatttagtagaacttgatataatgaagcatttgatggcccacaggacattagcaaaaaccaatgatcctaaaatgattcttgcgttcttcatgatgttcacctatgaacacaaacgctattcatcgttatctgaacaagaacagcagttcattcttgaagaaaagacaaaggcgcgaaaagcaatgcgcattgttaaaaaagaacagatgaaaggcaaacatgacggtaaaaacaacccattttacgggaaaaaccataccgacgaattcagaaaaagaattggtgctgttcataaaggaaagaagctatcaccagaacatatagcaagtctcgttgctgctcacaaaggcaaaaaacgagaaaaggtacaatgcccccattgtgggataatgtgcgccgctaatacagcgaagcgctggcactttgataactgtaagtctggacgcgtccagcagggggattagaaaatttttggatactggtataatagttcgctgcgtaactacattgttcttatgggacaattgtttaaccatgttcaggttaaaagagtacgcggcgatcaagaaaaatacatcaaggttccgatcacctatgcatcgaaagagaagtttctcgcttccatgaacaaattcaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtgtatacgcgatatgaagatgatatgttccagatcgcagaacagattttgccatattttcaaccacacttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagattgcattacacaacgcgaagaactccgaatcacctcgccacgtcgaggtattcacaagcctgatgaatcagttaaacgtttcaaacattggcctgatgaagattcacaaagaaatgcgtgagattacggaagagactacaaaaccaggcgctgaaaaaggcggtggtgatggtttgaatatcgagaatgcaaccgtatttgttggttcccctacggaactaatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcatttcgtgtgtttcaacgaagataaatatgttggtgtgttggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacattgacgaatgcgcgtttatcccgaactttgttgatgcgtggttagcgattcaaccagtaatttcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggtgacaacggcgtatttgatgacggttattcgtggtctgctaagatgatcgctggctccagcaaagaggcattcttgcaggaacactgcgcggaattcatgggaaccagtggaactctgatcgctggctggaagttgtcaaaactcacatggatcgatattgatgaaacggaaacgaacttttatcagtataaacgtccagtagaggggcataaatatgttgcggtgcttgatccagcggaaggtcgcggacaggattaccatgcaatgcacatcatcgacattacgacgatgccatttgaacaggttgcggtgtatcactcaaacaaaacgtcgcatcttattttgccggacatcctgttacgttatctgaatatgtataacgaggcatggatttacattgagctaaatagcacagggcattcagttgccaaatctctgttttccgaactggaatatgagaatgttatttgtgacagttacaacgatctgggtatgaaacagactaagcgatcaaaagctatgggatgttcgacgctgaaagacctggtcgagaaagataaattgatcataaataacaaaaagacaatactcgaatttcgtactttctcagaaaaaggcgtttcgtgggctgcggaagaaggatatcacgacgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaactggtaaactattttggttcccccgacaacttgaccgctgactatttcatgagtgctgttaacttcttgcagtacggtaatgatctccgtgtggttcgcgttgtcgataaagatgccgctaaaaacgcaagcgcaatttttaaccagatcaaaacaactatcgcatcacagggttctaactacactgtgaacgatactattaaagtaaaatacaacagcgttgttgtagaagaaaaaggtaaagtgtccaaagttgacagtaacggcaagatcctctcggtaatcattccaagcgaaaaaatcgttgcccgtgctaaacagattggtacttacccagatatttctactggctggactaccgaaattgtttctcagtcttccggtgtttctgcgtcgattacgattgacggcatcgaaagcgattctgggatcactctgttgaacctggatattgcaaaagaaacaattcagggaaccgctttccagactcttacccagaaatatcagttgccgtctgttgtggctctgtatcctggtgaactgggttcaactgttcaggtggagattatctccaaagctgcttacgattctggcgctatgatttccggctacccttctggggtttccgttaagaacagcggtcgttctgtaatgacctacgggccacagaccgataaccagtacgcttttgttgtgcgtcgtggtggtattgtacaggaatccttcatcgtgtcaaccgagaagaccgataaagatatctatggtgtcaacatcttcatggatgactttttcgcgaacggtggctctcagtacgtttacggtacttccctgaactggcctaaaggcttctccggtatcctggagttcggcggtggtttgtcctcaaacgatactgtaggcgctgatgaactgatgaatggttgggatatgttcgctgatcgcgaagctctgcatgtgcctctgttgattgctggtgcgtgtgctggcgaaaccgtagagattatgtctaccgttcagaaacatgttatttcaatcggtgatgaacgtcaggattgtaccgtgtttgtgtcgcctccgcgctcacttctggtgaatatcccgctggcaactgcggttgataacatgattgaatggcgtactggctataaactcagtggtggtgctgctgttgataacaatctgaacgtaagttcaagctatggcttcctggatggtaactataaatatcagtatgataaatacaatgacgtgaaccgttgggttccgctggcaggtgatatcgctggcctgtgtgtttacactgatagcgtttctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacggtctacgtgaaaccgcctcgttctatcaactacatcactctgaacttcgtagcaacgtctacaggcgcagatttcgatgaactggtagggccgcaagccgtataaagtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgatcacaccatccacgggctgttccctactaacgtaggcgaagttaccctggactgggacagcaacaacgaagtgtcaacctttgaggttacgttcgcgctggactggtgggaataaaggttataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcgattcaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgtggttatcgcgaatttttcgtgtatagcgctcctaaatctggctatacatacaacgggcaaatctatcagcataaccagaaggttaaaatcccgcgctccgctatcgtgtatgcgcattctggtctggaagattgtagtaacaacattatcggatatcttcaccgcgcagtcaagccagcaaaccaattgcgtttactggaagatgcgatggtcatctaccgtatcacccgcgcacctgaacgccgtgtgttctacatcgacgtaggtcagatgggtggcaccaaagcgacacagtacgtaaataacattgcacaggggcttaaaaaccgcgttgtgtacgatgctaaaacgggtactgttaagaaccagcaaaacaacctgtcaatgacagaagattactggttgatgcgtcgtgacggtaaagctatcaccgaagtagacacgcttccaggcggtgctaacttctctgatatggatgatatcaaatggtttaaccgtaagctctatgaatcactgcgtgtgccattaagccgtatgcctcgtgatgatgggggtatgcaaattggtggtggtggcgaaatcacccgtgatgaactgaaatttagtaagtttatccgcacactgcaaattcagttcagccctgtgctttccgatccgttaaaaactaacctgatcgcgaaaaaaatcatcacagaggaagaatgggaagagaacgttagcaaaatctccttcattttccagcaagattcatattacgcagaagtgaaagatattgagatcatggaacgtcgcctaacgttaatgtcacaggttgaaggtgtagtagggaaatatgtatcccataaatacatcatgaaagagattcttcgaatgtctgatgaagacattgacgaacaagcgaagctgatcaaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacaacgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggacaatgaacctcatttagccctggctatgatgtccattgtcgagggtttgagtttagatgaagtcattgttaaacacgtagattcgcgcggtaatgtggaacgtaaaaaagaccgcaaaactcgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctacaagccgaaaaagtcaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattgtggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaccgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaactctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcgcaggatcttcgcgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaagggcttataagttgttgaaaaacaacgactttttaaagggaaccttcgggttccctttttgtttatataaataatgaaaactattgaggctatattatgaaacacatcatttataaaataacaaacactataaacaataggatctatatcggcgcacattcgactgatgatattaacgattcatacatgggttctggtaaagcaatcaaagcggcccaacgaaaatatggaattgataatttcgtaaaagagattttgttcgtgtttgatacaagcgaagaaatgtatgaaaaggaaagggagattgtaaatttggatttcgtcaatcgtcccgatgtgtacaatatgggcgtaggtggttctggtggtcctatgctgggaatgtttcattcagaagaaaagaaacatgaaatatccaaaagaactcgtgaaagaatgacaccagaagtaaaagaacacctttcaaaaataaaaacaggaaagaaacaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtctgcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacacaaacagcccgttcgattatatgctgactggctgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggtccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagtggttgtatcgaagacgaacgcccagatttatagcagtaaatataattgtagggcaagggcatgtttaccgatggatgcattttcataatcggataaacctaatggcctatatggaatgcaacatatattcgtgattgggatttttttctcaacctggaacctttatgctaacagtgtgcaacggcacgaactacgattgactaccccgcaaatatacgattgcatgttgcggcgaatgtgtcacagtaccccttgtggggcatggctggctgattaatcagcttacgcagtttagaatagcggtgacgacaccgcgttaaaaatcaactatgcttcaaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattctgcaattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttggtctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtaaaaatacgcgaaagaattcgacacactgaaacaggcgtatattgattacaccgatgttgatttcatcgaatcccgtaacggttatctgtataagctgagtgattttactcctgctgaacctgtcgtaacaattacaccgaaaaccgctcctgctgatttcaaagtaggtgatgcggatctggctgcaactgatctgtttaccatcgatccttctggtacagcaatgactctgagtgttgactcttccggtcatggttctatcgttggtggtaaacttcatgcggttagtgaaggtgatgttgtcgtaacagcaacctctggatctgttactgcaactctgacggtaaacgttaaagcacaaccagtaactattaccgtataaactaagaaggtaaacaatgctgctatttgaattcaatgatgtattcgcaaaattcagcgatgcgatcgaagccaaatttggcaaacgtcctcaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgtcctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcatcacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtctggagaatagcgataagctgtaatctctgaaaacaaggagataaccatgaataccattaactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcctggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatgatgtgtaaattgattttgtggtatgctccgatcggttcagatctaactcgcaaaatcgcccgtggttatatcatgacgaaacgtgagtttgaccagatctggaacgaacccgactgtttcgaacgcgaaaaatacgaaaatgaggttagttgtatatgaaactatttcatgttgtgtatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttaatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgctctgcgccgtgtgtacattaataaacatcgtgaagaacagcgtaagcctaagaccaaagctaaacgcgatccgcgtccagataacaaacgtaaagcaatcaacggcgctatggcgctggcattccaggaagcgggtttagcgtaagaggtttacatgaattcttcaatgatgaatcgctggtcgggcgtgataacttcgactatcaaaaaggatttggtgaaggttgaagcaaaaccaaagccagtagaaccggaatcactcgatcctgctgagttggaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaaccagtatgttcttactccggcagaccatttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgatcacttcggacggtatcaaagtcattccggcaaaacgtagcggtgaaattctccctgctgaacagttttacggttgtgaaccagtagttgcaaaatactctgaacctgttcgtaagctgtgggaaattctagcaaatacctgtgaatataaggaatatgctgatactggttctttggttgttcaggtatacggcgaatttgcggggcgtggtgttcagaaagatgttgactacggcgaaaaagatttctacgtatttgatatccgcgttaatggtcaattcctccctgataacgttgttgcaaattacgctgttgctgttggcctgaaaatggctccactgctggcatacggtacgtttgacgagatccgcgcattgcctatcacctttgattcggtggttaacctggcgaactccggtgcgatccctgcaaagaacggtgttgaacctgagttcaaaaacttcatgatgttgaaagatgatgaaggtgagaacatcgcagaaggtttcgtgatgaagcctgttcaacccgctttcatgccgaacggtgaacgtgttgcaatcaaatgcaaaacgacgaagttcaccgagaagaagaacaagcaagcgaaccgcttcaatgctccttctgaactgtcagaaacagacaaagtgaagctgaacgaattcacctgcttcctgactgaaaaccgtgtgaaaaacgtcctgtcaaaaattgacagcgcgaatatcaccgcgaaagatttcggtcgcgtgatggggctgacggtacaggatgcgctggaagaaatcgaacgtaactacggacctttcctggaacagttcgaaaatccaacgctggcgaagaaaaccttcactaacgaagcgtcaaatctggttcgtgagaactggggcgcaatcctgaacaatgaattttaaatctgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaacgttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgacgaaatcaacgcgaaaatggtcgaagcatcccgcaaagacatttccgagtatgtcctgaaatatccgactaaacaatcatatacctttgatatgaaacgttttatcggtaaggttatggatcaggaatgtaccgaaaaagcatatgcggatctgggtgaatggctggcggaagaagggtttactttcgatacacagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctagaagactgggctgactttgatgaccttgatctcgatgatgaagatggagaattcttctgtgttgggcgcggggttgaaagaacgaagcgtgaacttcgaagccgtttagcaatggggcttactgttggatctggaaagaaacagcaagttaaatattccgatggttctattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatataaaaacagcatcgaaatgttcggggatagtttctacgcttgtgtgtacgattcctgggactacaaaggcgctgtagatcgcattgctgaatataaagagcaaatcattgctgcgggtggtactctggttgttcgtcctgattccggtgatatgattgataacatcatgtacaccctgcgtaaactgggcgaaatcttcggatacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgagaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcggattgcttatctgttgaaagataaaaaagatgaacaccgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgctcccggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcacgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggttctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaagcagtctctattacctgaactcttcaagttgttccccgaaagaagttcatacatgcgtttcattgattgtttttgcggtggccttagtgtgtcgttaaacgtccctaaacccgttctaagcaacgattacgataagacgcttattgatatgtatgagcgtcttaaaacgcttcctgacctgtctcctgtgcgagaattgattgcatcgaagggactggggaaagacaagaaagaagagtatctgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtattgtgatccgccttacctgatcaccgatgcagtgtataacaagttctggaacgaagatcgcgaacgtgagttatatgctttcctggatgaactgcacagcgaaggaatcatgttcgggctgtccaatgtgactcaccacgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacacgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggcgagatcgagaaacatcaccttgaccatgaccatgcgttagacggcgaaaacgccggacgtgtgcgcggcctactgtgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcgaacaaagacgcaagggtattcccgacacagcgcgatctgctggctggtatcgtagcgaaacacttcgcacgtaaccacattctgccaaaacacattgtagaagcgcatgattctggtgatatccattatcatgatctggattacagcccgttcacgccatacacaaactgctgtctggtggatttgaaaggtatgctggctaatggcttcaagatgggtaacgcagacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcatttggtgtccgtctgaatcctgatgatgaaattctggaactgttcaaaaatgggcgtagttctatcagtctgggttatattggactgcacgaaacgctgttgatgtttggctcaggccagcatccattcgatcgtatcggctcccagaaattaggtcgattgatcattgaatatctccgcgctgcaaccgaagcatggaagaagaaaactggttttggattcagtctgtattcaaccccagcggaatcgctctgccatcgcttctgtaagctggactttgagaagttcggaagcgtcaaggggatcacggataaaggctggtacacaaacagtttccaccttgacgttgatcgcaaggtgacgccgttcgagaaaatcgactatgaagccgattatcattacatcgctactgctggtcatatcagttacgttgaatttcctgatatgaaaaacaatctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggcaatcacgatccggctaaaatgagcgtcacgcgccgtacatgcggttatttgggtgctcctgctgtccgtggtttcaacgaaggtaagaacaaagaaatgatgcaccgaactaagcatcaaaattaatcaaaaagccccttgcgaaagtgaggggcttttgttatattgcacataccgaaactatgaggtattgaaaaatgatgtactggacaaaagattattttgaatttcgtgacgaagaaagttttgggacggtgtaccgcaatttagctttgcgtggtagtcctctgtcgcctaatcaactatcatctgtcgtgtttcctatcaaggtaacgcactgcgatcggaaaggtgttaatgggatcgttgatgccaatggcacaacatggtattccgaagattcttatctgtttgataacgaggatcgcggattctttaaaaagtttgtcgcgattaaacctgctgttgaaaaagccgacgcgcaacaactgctggattgttctcacctgctgggacgaatttacgtagatggtaagctggtgacgaaaccaggtgatctggaaaaattcttgcgtaaggcgcgggaaactaccctgaaagagaccgaaaaacgttacgatactgcaaccgccaatctacagcgtttgtctggtgaactgaaagttctacggggtgaatgatgtttccattaaaggcgcgggtacgcaacaaaaccggaacacaagaatggatggagtgtttacgcgaaactaaacactactacatttcacaggctgtaggctatgacggaaagaacattcgttataacaaagtaggtggtaagcgtgtggggatggaacaatatctccaattagaaaccgtccggcctgtgaacgttcctttcgatctgaaactaccaaacggaaagccaacgatatgatcgggaaaatccttgatactctgtttccctcccgtgtacgcgcacgggtagaaagagaaaacagactggaagagatccgcttcaataagttccttgaggacaaaaagaagcgcgaagacgagaaacacccaaacgcaaaaatggctgagggtgtatcgaaatgttctgttgggcggttctgggttgaaaaggattatcttgatctgataggtgctattgcccctggggttacgctggaggacttctccagtgctactgggcgttcgtatactggttgcatcaaccgcttgcgtatgctctctatagtggtgcgtagtgcgcatttcggctatcgcgacgttatccgtccggtgatcccagtaagcagattaaaattttacatggcgggtggaaaaagacttgacttgaccaacgaactatgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagaccttcacactggcaaagagtcggagatcaaaaaactgctggcggcggggcaggaagtgtccaacagtcattatgtgctggcgctgcaacatcgtaacatctggcagggcttgcagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttctgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgaggattcttgtggatgggaatgttccacagcgcgtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaaagagaggaaagaaatgatgttcgaagacggcggtagtgcattcaaaccagcacgtaaaacgtatccagactggcgcaaacagtacgcagaacagttatggcacattgacattcccgaagcgctcatgaaagcgattagccctgctgttgactactattcaggctggaaagatgaatatgagttagaagtcggttcgtttaaggcgcacgtcatcaaagcgaccagaattcttgatttcgttgaagctgttgcgtcatgtgatatcgttgaagatattcgtattccttcaatcaacgtttctcggtatagttctccgggtaacattcgcggggatcgttatgcgaacctggcaagcactacggataagctgaacttccataaaatcaatgaaaaaggatttgatggttgtgttctgatttcaatggtagtcgccacaacacaaggcgaatacaagctgatcattgattgtgacaaagcggctcgtgcaattcccacagtcaaacaatgctttggtgaagatttcaaagtgttgatgaaagcccgcgcaatggaaaaattcatccattcgtgcaaaaagaacgtgctggagaagtatgatccggcgctcacatacaccaaaattgataaagatctggtaggtgatttatgctgatcaacaaagcgcagtgcaaagcgataaactttcttctgcacgaactgattgaaaacggtatcagctttgaattcgttgatccgattaacggtgatgatcgtcatctgctccgctgggtgtctggtagcaatccgctggattcagtctcccaggttgtagagtctgcgcataataatatgccttgtcgtgttctgttgggtagcgttaacgcctccacatggaatggatctgatgcgtattatgtcggattcaaaaagagttgacggacgacgcatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaaaggatcaaagaactgatccttgagaagaaaggcactataaaatgattcaaatgaaattagatacccaagcgctgaacaatctgttcccaggggagaaaggctgatgaactttgaccgcatctataacatggatgtggttaacggtaaaggaatccgtgtagtgttgtttgtgactggatgcaatcataaatgcgaaggttgctacaacaaaatcacttggaatccccgcaacggtacaccatacaccgaagagactgaaaacgagttgattaaacttctttcaaatcctcatgtggacgggttgacgcttacaggcggtgatccgttttaccgtaccaatcatccagtattgttaaaactgcttgagcgcgtccgtgcgacgtttcctgataaagatgtgtgggtttggacgggttacgccctcgaagccttacagagcgatacaaaacgttctaagctgttaccattcattgatgttctgatcgatggacgatacgaaaaggatcgaccgactaagaaaccgtttcgcggttcggataatcagcgaatgattgagttcaaaaagaattccatcgaaattaaaaatatcgcttgacctggttggtagttctgttaagatatccacgtagcataaatttaacccaattgagagataatatcatgatcctgaatttcaaaacccgtaatgaagcccgtgcatattgctggaagtggtcaattccgctgaaaaacatcaccaaaggaagcggttcgcatccgtggacggtgagaacaaaagaaacccgcttcgaaactggtaaagattacaagcttgttgatgtcgaaggtttcaccgacaatggcaaaaacattgctaacagtgttcagtcaaaacagatccaccaattactgaacggtgttgtaaacatcgcaagccgtaacggtgatcgctacaccttcaatgctccagcaggtgtcgctatgaacacccttcgtgcatgggaagcgaaatacttcacagaagttgctccggctaaagccccagcgccaaaacgcgctaaaaagccaaaaccagtaggcaaaccgtctgttgcacctgcaccagcgaaaccggatctggattctgaactggatggtggtgttaacctcgctccggcagtaaccgaaccgtctgttgctaaacctgctgcaccacagccagcgctcgtagaagcgatgcctggttgttttgttgccgaccgtccgtatgttctggtagatgaaccaggtttcctgcgctctcacactgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatccccagaagtctttgcagaaaagacctggaaaactggtatcgcaaacatcattcgtgaaaaaggttatgtgacgattgatcgcacctcgattggtgagttcgaagatcgcgcctttatcatggacggtggatacgaatatgaactccctgcatcactatggaaatggttcaaggaagtaacaccggaagatggtgaattcaccccagaagaaccagaagaagttaatctgggtaaaggtgtagaggctgaaaacgttatgcgtatcgctacaccggaagaggtttccgctggtgtcactggttcggatctgtgcctgatggatatccctaaattcacgtatcgccctgtaaaggaaaatcctctgcgtgatctccgtatcgatccatcattcggggctaacctggaaacgttgagcatcgcaccgatgccagtacgtaaatccgatgcaatgcttcgtttcgccttgcaacatgttttcggtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggcattcccgaaagtcttcataactgttacgggtgcatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaactgaaacaacttattggtgattaaatgagccgtgaaattttactccctgctgcaaatgctgttcatgctgaaacgatggaatacatggagaaattcgttgaacgcgataacaccgcgatcatcactcctactcacctggacgcgctcgaagatcgtcttcataagcagattaaagatcaatttcccgaaaacttcattcgtcaggaaatcgttgcaatgatgctgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgattttcatcactcatgcagcactgaaaaacattgatgactttgatttgtataaggatttttccctgtatattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatggtcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacaattacagggaagatcctgcaaacgtttcatgatgtggagttcaaagattcaccgcttcaaaagctggttgactttaagcaatacaaaaacactgggcgcatacatatacatgtgctcgcagagggggattattcgcgttatacgggcgatctctctcaatctgggacgacagtatacacccagattaaaaaacgcgtggaggcgcttctagggggcgaacagttcatctactgcaccaacacgtatcgatcgaagtttagcgaggggcaagaaattccgtataactcgcacggattgaacttctattcgagctatactaacgtggtagcattattcagttacaacccgttaccctggcttcgtcaaatgttgcgagcggttgcggtgtcctctggactcgaagaggaagaattagttgatgcttatgttgtcagtaaatattacgaaccagcctttcagttatgcgctcgttctgatatccgacacaacaacagcaaacgaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcccgctctgtgttgagcgacggcgtgaacgttgacttttttaacgaatttaacacgatccaacaatacgattctacccgtggctatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctgttgaatccggtacgtacttactggctgatggtcgtttctctgaactgacatatattctaccagattcccctgttgagggtgatattatcaccattaaagacggtggcggtcttgcaggtctcaacaaccttttggttcgttcaaacacccgacagatccgtttgcgtgatattcagtcaagctcttatcgactgactcacccatacatgaccgtagcgtttatctttaacggtaacttatggcgtgtttctgaaatgcgcgataaccgcgattcgcagtttgtgaacgcaacaggtgcgggttctttccaactgcaagcgggtatggtaacattccgtaatagcggtacaggcaagattactctgcaattgcctagatacgcaaacgatggtgactcaatcacaacttacgatctggatctccttgcttcggtgaacgttgcgactctgcaagtttatcctggtagcggacacacgatcagctatgacggtatcaacaacgtaacttctgtgacttcacagcgttccggttatggtatcttcatgttcgatcaggctaatagccgctgggtcgtttatgatggtgatcagcgcgttcgtctgcgtcgtatcagtgatgacctgaacatgttgccgaacgattacgtgtttatcaccccgatcgctggtagtcctccaactgtgcgtaacgtaacgctgactcttccgcaagatgttgccgaaggtgatcgcgtgtatatcagtatgtatatgatggggaaaacgcagaactgcacaatcaaagttaaagatgattccggtgaaaagatccgcaccaacaaaaacatgatgcagttcccacagcgtaaggattatccacctgatgactggttcagtgttgacactctgactttcaacgccgatactgactatcttccatatatagaattgtcgtatctgaaagctacgaaagaatgggtagttgcacaatatcgcccgatcattgaacgtgttgatccaacaaaccgttctcgtctgggtgtgatcgcgctggctacacaggcagaagtaaacaaaaactgggaagatttgccttctgatgaactggcagtaaccccgcgtacactggcgaataaaactgctacggaaacacgccgtggtatcgctcgtctggcaacaactgcggaagttaaccagaacactacggctacttttttggatgacgtaattgttacgcctaaaaagtttaacgaacgtacagcaacagaagatcgccgtggtgttctggaaattgcaactcaggcagaaacaaacgctggtactgatgacactaccgcaatcacgcctaagaagctcgacacgcgccgcgcgaccgaaaccctagcaggtatcgggaaactcgttacaacgggcgctacgacagcggagggggctttacgtggggatgctggtactaacgtctacaacttcaataacggtgttgacttactgactccgaaatcattgaacgagaagacggcgaccgaaaagtcaaaaggtctggttgttctggcgaccgaaaacgaagtggtaactggtgctgctgctggatctgcttcaatgccgatcgtagtaactcctgaaatgctccatcgtaaaacgtctactgaatcgcgtatcggtttgattgagatcgcaactcaggacgaaacgaacacaggaaccgatgatctccgtgcggtgacgcctaagaagctgaacgatcgcaaggctactgaatcgcttgatggtattattgccctcgctaccactgcggaagttgcagcaggtacggcaacgaataaggcagttgttccggttaagctgaaagagttcttcaacgttacgagtcatgttgcggttgcaaccactgatggtttaactcagtccggtactatctggacaacggttaacctggggattgcgtctgctactgaaacacagcgtggtactctgcgcgtagcgactcagggcgaaactgatgcaggtactctggataacgtggtcatcacgcctaagaaactgcaagcgaagaaagcgacggataccgccgaaggtatcattcgttgtgcaaccaacagcgaagctgctgcgggtactgctactaacctggcaattactccggctaccatgcagttcttgaacggtactgatccggcatggggtgctacaacattgcgccgtggtgcggtgtttatcactaccaaatcgaacacgttcatcggtgataatctggttggttctactcagcctgtagatagttatctggaagatttctacgctgtatcgcctcgcggtctgaactttgctctgcaaaacttcttaccgttgaacgcaacagcacagaatagcctgaaactgggtggtgtggtagctgcaagctggatgcgtcgtgatgcagatcaaaccgtaacgggcaacaacacgttcaacggtacaagcaacttcgttggtaacgtaaccactaacgggactctgacggctaacgctgcggtaactgttaacaacaccgtaaccacgaacaataacattaaccagtctgcgaaagcaaacacggtttatgctaatactgttttgagtacagcaaccgctggaactaaaaacttgcttcgtactttccgtggtggtgtgacggatactacatggcatgaaactgttcagggaactacgtatcgcttgtcaactggcacaaccgacacgaccgacgttctgactgttggtgatgtatctaacggtacaatggcttactccggtactactctgcgcctgaatggtaaagcactggctaacacgaacgcaacaggtgatgtgactattgcaagtgatgcaagtcctacggtacaattacgaaccgatgcaactaacggttggaacggcgtaacaatcagtaatgataacggcgtgactactgcaaccgtaatcaacaccagaaactttacccagcatcttgacagtacctatgtcaatacagcgggtgatactatgactggtgcgctgtcagttagcgtaaacggcacgggtggacgctttaccagtgtgagcggtacggcacatgttcaggcgggtgatttctctggtaacgtccagaagatgcgcttaactggcattgacgataaggtattgactgaattcaatatcaatatcaccgattacaacaaagcgatgatcaacggaaacctgatctatcatgcaggtcgtaaaccaactccggcagaaattggggcggttgcggttgcgggttcaactgtagatactctggttgttcgtgattacatcaaaatcggaaacgtaaaaatcttcgcaaatccaacaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaactaatctcgattctgcggtcaactcggttgaggtatctattaacggggctgatattataaacagacgaacacaagttgctcgcggaattaacctggctgtcattgatggaacaactttagcattattggattacaaagcattcgatatgtatggtgatcctgctacgaacgggaatgcgattaaagactacctgaattcacttccagcgaacagaattgtatgtttttatactttcgatgctatcaaaagtgacgatgactttttagcaacaatgaggaaaataggttctgttgcgtggcctgaaactcggttctttaatatcccgatcacaacaaccaattattctcaccgttcatcctattcagctatctattcatctacgatgaaaaagatttgcatggaaaactttgtcggtggtgctggtagcctgaaagacaatactacgagttttgttgaagtggtgtttgatgaattcagtgatatcggggtaactggtattccagaaagaatggtcgatgatgtccagacataccagaatagcggggatctttatggcttccacgattacgggacgtggattgttggtagtgatgtttttctgggcgatatcttcaaattcacgggtgaactatattgttcgcaagaacttcgtgatgcaggtggggaagtttacctgtatatgtggactgaaaacagtaccggacaatggatctcttcaaccattcttcgaacaactggattagcccccgatcagtggcattcattatcaggatatttcactgttccgacagatccggtaaacgtcaaaatgggttcgcaggtatatcattatccgtctaccgttaaagtggggctggcgcaatgtcgcaacgtccagatcacaaaagtacctcgcgaagaaataaaccggaatggtgctgcgcttggtgtgaacggtgttcgaatgcagacactttccgaagtggacgcaagcggaaatgagaacccgattgataaattgctttctctacccgtttcgcctactggtgttgcaagtgataagaaaatcatttcgcataactttgctgaacttgattatattgtttctgatccggttgaatacacttcgacaaatacagcggagtacccgttcaaaggatggactgctacccagcaagcggcggtaacgaaagcatcactaagcagttatggcttaaaagctggtgatacgattcgtatgcaatgccaaatgaaacgcgatgtgaacgcaatcactaacggtaaaagcgcgtatatcacaatacagttctgggacgcgaataatacgtatatctcaggaatcaacatgcgcgatgttggtacgatccctaacgtatattcattctacaaaaacgaaggggttattcctgctggtgctgttacgtttgatttcggtttataccgttatccaaacaacacaaacatcggtacggtatcggctaaagacgttaaactgtcaatcgtgagataaaggggcgaaagcccctttttcataaatacagtcattacaggagaaatttttatggctgatttgaaattaggtacaacgctgggtggtgcgggtatctggagtgcgtcaaacctccctctgttgccctctggcgacagattgacgtataaagggtggagagtatacaccgaaaacgatcgtccaacagcggaggatataaacgccctctcgacgatcaacggcggtactgttgcgaagaacaccacgttcaaccaaagcgtgaccgtaggtattaacttaacagcgaacacgctgtattcaaaaagttatgtcgatatcaccacgggcggggctgctccgggtatattgtttaaacgttctgatgtgacgggaacaccttcaaccgaacagggcattatgcaaatcactggggttaatgcttccggcgttgcgctggcaactatgaatattaacgcccgtgctgacggtggcaacaggatctatctgaacgcatacaaaaacggaacaacaaatacttcctttgttgttgattctgcgaatcaacaggtatccgttgaactaggttctttccgtgtagccggatcatcgaccttctctgcggtgagtgcaaccacgttaaacgtaagcggggcaattactgctaatacggtaactcctactgattggacaaaccacgatagccgttatatcacgggtattcctcgcagtatgcagggaaacagttttggtgctgctgttgtaaccgaaaagaacgatgttctgtcagtaaacggaaacattgttgatgggccttacgggaataatacgtatagtggtcaggttgtcaatttccggcgcacgtcgaatacgggtaatgctcttactcagatttatctggataatggtgtattccatattcgaagcggttctggttctcctggtgcttggtcttggtctgctggcgacgctaatggttggcgtaagatctacgacgaatacaacaaaccgactccagcagagatcggtgcattgaaaaatactgccgacacgatgaacggcacacttagtgtaataggtgacgttggtttgcaatctgcgttcggtagacattttaaatttacatatttcaaaaacgatggtactcctgttgatgacggatacatttttaaagatggtccagatacagcaaaccgccgtactggtgttcgtatagttgcgtctactccaaacaaggcgaccggaaacacacaaacagcagaatttatttttgatgaaaacggttcgtttgttgtcggtgaacgcggtacaatacatcaaaatgggcttagtcctggtgtatatgcaaatagtattttaagccctaatgcgagtggaagtaaacaatatttgcgtcgattccgtggcggtgctcctgatgttatatggcatgaaacagttcagggtaacgtatatcgcttattatgtggcgttactgatacagatgagatgttgtcgatttcttgcgatggtgcgatgactttccggcaaggttacggtagttcaagtaatttatatctcgatagcaacggtaactctgtattgtggtttaggcttaataacggcgcggaaaaaggtgctgtttgggcagaagcagacggcaaactgaaaattcgtactaaccacacattctcgaatacatgggaatattacgctggaatgatacactcgacaagcgctgtatcagggactgaccgaggtattattcgaggtactcctgatggcggtggttgggatcaatggcgtgaacgttctgctgcggtatctgttgatgttcctggagtaaacaactccgcttatagtatctggaaagcaacttcgtggaacaacacttatgttgctgcgatggacgttcacatgcctaacttcacaccaggcgcaactcgtgttcgtcttgttctgcaaagctctgttgcattctattttgatggtgatggtagctttacaacatcgactggtaacattacagcaggtgctaacggatactttaacgatgtgtatattcgttctgatgaaaaactgaaaagtaatttcaccaaaattgaaaacgcattggataaagtcgaactgcttgatggtttggtttatgataaatcaaatcatattggtggtgaacctgttacccgtgaagctggtttgattgcacagcaactgcaaaaggtattaccagaagcggtatctgttggtaaagataccaaagaaaacgaaatattgacgatttccccgactgcaacgatcgcactactggtcaacgcaatcaaagaacttcgtgaagaagtaagggaactcaaagcccaaaaataagaaaagcccttcggggctttttctttttataaatatcataaaagcatttgaggatctaataatggcagatttaaaagcgggtactaccgttggcggtaatactatctggagtcaggctaacttgcctttgctcccttctggaaacacaatcacatacaaaggctataaagtatacaccgaaaacgataaaccaacaaaggcagaaatcggattaggcaacgtaacgaatgatgcacaggtgaagaaagctggcgacgaaatgacgggtaatctgacattaaagaacaacacccagttaacggttcctcgtcgtattaacctggttgctgatactgcggggaatgctccttatctgttaactactcgttcagataacaacgcggttacagatccgttcccgtcacagcatacgcgcacgtttactttgtttgtcaacacaaaatcgaatacttccgatcctgctggcggtgctaaccttgctgctctattatcgcaccaggcaactactggggcgggttctatcgaactacaagcatatgatgcaccaaacaagacaacaggcgctacgggcattctacgcgctcagattgggcttaatggctgggatggttcaattaacctttccggtgcttcgttaaacgttggtatgagtacaacggtcagtggtaacttaacaggaacccaactgatcacaaaaggcgacggaaaccgaaacctgtttttccgggattctgcgggtaacgaacttggtttgatttatgcagatacagggaagaacgtgtatgttcgatctggtggtggttcgtatgcaagtcgttttgcttctgatggaactttaattctcgcaaaccatctaaccgttcctggtctttcaacatttacaggtcaggcgacgtttaatggcagaatgaatgttggggctgattacgctacacaaggggcgaacacatcaattcttcgtgttgatacaagcggtgatggaaacgcggttggtgatggtgctactcactttggttataaagatagcaacggactatataatcattatattcgtggtgctggtgctttgtttatcaacactaaaggcggtattagcatcaacgttcaatcatattataatgatgttcctcagaatatcccagcgcaatattttttatctggtggaacaactggtgctaaaaactatttgcgtcagttccgtggcggtaacggagacattatctggcatgaaactgttcagggtggtttgtggagactggcaacaggttctactgaccaagaagaggaattacaggtttcaaccgatggttatgttcgcgcccgtgcggaggttcaaagtacatctcctggtggcggtggtcaattccgcgcggttgctggaaactatgggttctttattcgaaacgatggtgcgaacacatatttcctgttgactaattcgggagatccgtatggtggttggaatgggcatcgacctttccaggtcgacaacagtaacggacagttaacggtcggctctcaaggtcttgttgttcctggttccgcaaggtttaacagtggtcttggttgtggtactctgaacggtttaggcacaaacgctatttgtttgggtgatgacgataccggattccgacaggaaggtgacggtgttttggatgcttacgcaaacagtcagcgtatcatgcgttggacatcaattaatacttcatcatataaaagaacatatgtcgaaggggttgaagggccagcaatggtattaaatggccctgcggttaactcgtcatgttacctacttattcaaaaagcaggtaataacggtatgtatatcggatttggtagcaacgatgaagttgtaacattccataactatcgtttaggcacatcactgatgcttaccgatgctaacgtgtatactaaccgtggtgtatatgcagaagggaacggtaactttaacgatgtttatattcgttcggatattcgactgaaatctaatcttgttgaattgaaagattcattaagaaaagtcgaacagcttaaaggttatatctacgataaacaatctaaggatgcagacgatatcgtatatcatcgtgaatccggtcttgttgctcaggatgtcgaaaaggtattaccggaagcagtacgcgaagaccgcgatactggtatgttgacgatctccccgtctgcaattaacgcgcttctggtgaacgcaatcaatgaaatccgcgaacgtctggaagtaatcgaaaacaaattaggggcttaattgcccctctttcatgaggtattttatggctattgtaggagttcctgggtggatcggatcgtctgcggtcggcgaaacaggacaacgatggatgtctgctgctggtaatgccgttcgaatcggtttacccttctggatgtcacaaatggcgaatcagtccgtttataacatcaactttacggtgtatgagcgttactataacaacgcccgttatcgtggtcagtggggggttggttggtattcaccatattcaaaaccttctggctatcctgcggtcgggggtagttttaacggcaacgcattcggtactgtagttgcagcacaatcaagcccggatattagcgtaatcaccatccaaaacggtcctgctgtcaacctacgtcttactatggatgacggcggtgtattcgattttgacaacaacggacgtatacatgatggatatcgtcaatatcaggttgtttcttctcaggcgaccagatggtatgactatctaaacgcccgtgtaggtcaaaaccgttctggtttggttactcaacgttaagtaaattcctaaatatgttcgggggtcggcatccccgaacttgaggattaaacatgtcgctattacaagataaattggcggtgcttgaacgggtaatatcgttcatcatggcggtcaaaacatggaaacagttattcattaaattggttcttatcgtcactattttcattatgtttgtaacatggtacaagtgggatgacttattttcagtctggaaaacatcttcaagcgttatagacgtgccgacgatggatattgaaaaggcaaaaaagtttgaatccgcatccatcgaacagttaaacatagtgcatttaactacgggtgcggatttttcggcaatctttggtttcagacctaagaatgtcaattattttgttgatataattgcgtatgaagggaagttaccgcaacagattaacccgaaaaatctgggtggctatcctatagacaagacatcggaagagtataatagacatataaacgggctatactatatctcagatattgcaagcccgtatcttccaacaaaagaccttgttccggtagcatatacctttagttgtccttatttcaatctcgaaaactattattctggatcgattctaatggaatggtatatacagaagcccgaagtcgtcgatacgaagttaatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcataagttcgtaaggtgtcggaacatattcatcgttccagtatccaacgttccctatcgtaattcgccggaaaccagcctctacgctgtgatatacaaagaacccagccttacccacaggggcgactttaaaaccgcgtgtagcggctttcatggcttcgtcgtgtgtcatgatagaatcacttcgcctctgaattgattgtggtaaatgtacggacgaacccccagcgggtgatcttcaataacgaaaaccaggtcaagcccgtcatgatgatcttcttctgcaacaatatcccaatcagtcgctttctgttcttctacgctcgcaatgaatacctggttaatctcaaccttgcggtgagaacgtcgaatgatcgtatccccttcacgaaacacgatcatatctgggttaattggacggtacgcggttttacccgcgcacacttcattaagcatttcttcgtatgtcattataatacctttactcgctgaacaatggtttgtttaacttctttgtattcgttgtgaagtttaggtgtcgctttgaagcgaatcacatcaccctcttcaacaattttgttaccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgttgcgctgctgcgatcttcgcctggcgctctgcttcccattctgcgcggatctcttcacgtttagcgatataatccttctccagcgctacgcccatgcagtaagagcaaatagcctgaaatactgggctatcgttgccgttttctttgcactgatcagcccaccacagaatagtatacatcggcatatcagcaatcacttcacctttacgcttgccgattggcatgatgcccttctccaacagttccagattttcggtatcctgtacagacagtttaccgcgacgttcgaacagatcgaaatctgcgaagccctggaacaccatctggaaagtatcggtctggttaagacgatccaccatgcgatcgaagtattcacgcgctttcgcttccgctttatctgggtcagtagacaggttgcagatatagttatcagaagtaaattcacctccacgacgctctacacgcagggtgtacatagcatttttagcgccagaagaaatgaagtatgtcgcggtaactttagtcaggttagtcatggtgaatctccttagtggtttcgtttcgacaaagccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgtataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggtttcgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggattttatccgcgatacgtccggcgcgtgttgcgcttgcggtatgatcgctttctttggtagccagttcagccagcttacgctgatgttcttcttccgctgctttgcggtctgctgctacctgtgcgacctgttcgttatcgtgagcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcgtgttcgcggcgtttgatacgtaacagagtacggtttgcgccagtcttacggcgttgatttggggctacgtagaatcggaatactaccttacccgttttatcatcaactaccaggtagaagccgtgttctttcaggtcaaccccttcgaacttggtgaagtcaccgcgcttcatgtcacctatcttaacagcgtatttgtggatgtcaagtcttgtcagaattcttttcatttttctttaccagtttatttccgaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgattaccagcataacataacccagattaaatgcaagggctgttgcgataataccgtaaggtttttgaaatatgtctgttcgccgtcttctgtacgtccagcggtaacgttgcctccgttccagatttctttagcggttttgatggctgtttctgccccgctcaagttctgccagtagtcaggaatgctctgtaggaatttcataatcgaatcctccgcgcctgaatcgctccaggcgctgttttggggttagtagtgactgaatcccacagttacatcacgcatcacctgataacgacatacgcgcatcttagcgttgtcgtaatctgttgggattgctacaacatcgcgaggattaaccttaacctgaatgactcgcccacgtcctccgccatagtgaggcaggtacgattttgcggcaacatgcaaaccacatgaacaggttcggtttttattctcgtctacctggttacgtggcatttcaaccacaacaccaggggagttatcgaacttaccggaagccagatcgcggaagtcttcacgaacacgtttccacgcgtagaaatctccatcatctgccagttcgatatcgttatgcaccatgaacccgtaaagctgatacacagcatcgcgtgaagggttttccatcaacttctcgaagaagttcaccaggtgctcatatgggcgatcgttgtacatttcgcgaacgatacgttgcgtgataccgctatcaaacacgatatctttgtacaggactttatgcccgatgattttaatgttgcctttgctgtaaatcttcaacgcttgcgttgtgtccaacagggtagcaactccctcgatatcgcccttaaccattaaagcgtgtgctttttcgaagttagggtgcgacgaatccgctgtgatgatcttaccgtccagtaccagagtaataaacgattcagaaccaatcattttagatttgacatctgtttgcggaattggttttgatgcttccgtattatacttagcgtgttgttcggtaataacgcgcccgatggttcgggcgcttacaccaaattgtttagccagtgcggttttgttcgcgctggtcagaaagccctcatagactgctttcttttgtacatcatcaaggatcttaacgtttctcattatttccaccgtataaggttgaccaaatccatcgtaattttttcgtcattaaacatactgcggaatgtagaataagacgaatgcagcaacatgtaatggattgatgggttgcgttctgcaaataaatcgtaagcagtatcaacgcgttctttcatatctttccgcattttataatacttcgttgacatttcacgaagtaaggggttacgcaccacagtttttgatttgtttttgccctcgatagtatcgtaggtgaacttaccatcaagataatcaagcaacaaatacaattctggattgtaacggtttttaaccatgcgatcaagggttacacccatagaatcacgcagggttcggatctcgcttccgtggtttgatgaaatccatgcagggaaccagttaggtttcatcttcttcgctgcgtctgcaaaacgttttaccagataatcatcaagacatttcatgttgctatctggaatgcgactccacagagagtttcgcagaaccatcacatctttcagccctgtaaccgttaacatggtcatcatactgctggcgatgctacccagagaatagttcggtgcttcgccatccagtcggctatattcatcaatcccgtacaggcgcatagcgtacatttcatccagattcacgaactgtgctttggtcaggtacagatcatttttctgtaagttgccccgatcatccaggaagtaatgatatgctgtaggcgttttcgggcgcgattcacaatcaccagaagatgattcacgcgttgctttccagcgcttgcgatcttccgtgtacacgtcaaattctttggttaattcactggttttcagtgtgacaatttcggattcgtcgaaatacccagttctgatcaagtcctgaacaggatcgctattaatctctttggttacgaaactgatacgatccgaaccgtgcaacatgcagtaaccgatcaggtatggacggagtgaacgcgcttcattgtcgttttcaacaatgaacagtttcttctgtcgccacggttggataatgcgcataacgtcctggcgtttggtggtttccgctttgtatgtctcataacggcgtccagatccaacgcgctcatatacacattctttcccgtcatatgggttagcccaaaagccccagacgtattttccggttgcagtctcaggacttttgatatgcgtcaggatttcagccagtgagtttttacccacacggaaacggttatcgcgggttacaaatgtctgtaacaaactaggcagattgttgaaccatacgagtttatcgcgggttgttttttgtctgtcgaactctgcaactaattcttcgtcatagcgtttgttgatcttttccagtcgatccaggattacttttttggtgactttatcaaggctcaactcttcacgcgacggcatgaagtccagcgatcccagagggaaatccagaatataagcgtaattgctgttacggtagcaatagaacagcgagttttcgaacatatccatgtcgattgggtagcaaatgttacccatacgcgcgtatacgccggaatagttgatggacttataacggatgatcccgcgttcgtctgcttcttttggttgccagttgacatcaacctgaacaccgataaagcgcggacggatacccgtgaatggttcgtaaacacgcgctgcttcacgttcccactctgcgatatcttcgactttcacaggaacagtgatttgaacgccgttaggttcgtctgtttcgatttcgtagatttggtcaacgaaaggttcaccattatccatgtaagccgtgtacgcgcgtttaacgccgtcctggatggattcgatagtgaatgtttcggtgtagcagaacggggatttactacccagtcccagcgccccgatcagttcgtcggtgtcggttttggttgattcgaagtaggtggtaaacacctctttaaccatccagtcacttaaccccgtgccataatcacggacgatgaaacgcggatcgagaacagttggtaactgaacatcgaacggattcatgttacccgctaccatgtgaccatcaatggcgttacaggagatctcgcgaatgattgcgcggatcttgtatttgtagatggttgatgacaggattttgaacgttttcgcactggtagccattttaaacttcgtgcgttcgcctttatcgaagcccgtagtgtgaatggtttgcggtgctaactgacgtaatttcattgtttatatctcacttggtgttaaagattatgtcgtcacaagaatatttcacaggcttttgatcaagcccgtattcaataggtttgcacatcctgttaaggtattcgtaaacctgttgcttctgacgttcgcggtctttcatatcaatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatatagatgtttgcaatgttgcgtttaccttcctggatctcattgtacatcttttctgtcatattgcactgataaacttcaccgttcggagttttcaggaaaaatgcgtatacgtctttttcgctttcctgaattactgatttctcacggatacggcttttgcatggtgtaggctgtgcgcccaactcgatagctttgcgttgccaaacgatcccgtgtccagccccttcggtcagagcatgagcaatttcgtgcatgagagtatctaaaacgttttcgtagatatcttccttaacgtgagaacggctcaactcgatcaacttgcgaccgtagctgcattgtcccagagtacgcttgaaacgtccgttaattttgaaagaccaatgagataaaccatgcttcgccatgatgcttttggcccaaatggttatttccatgtcgctacgagttttgaacatttttatatcctccccaaatcagtgaggacactataacaaaaaagcctcccgcaacgcaagaggcttttgtaaattatttcaatttcttcgaaagttctttcaaatcattaagatattcagttttcggggtcgtttcttcccagtatttcagttgcttacgcagttcgttcgcttcgtcttccagcttttgacgttcatccgtggttaaatggtagatgttcatcgcaaccaggatttcggcgtggttctcgcaacccgtccacgtagagacaagtttaaccgcctcgctgcgactaagccccttcaacgcgtcaggctgtgcgatcatctggtcaatgaagtcaaccttcgccagcgccttatctaacgcttccttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgtgtactcacgtttcagggtgatttcgtagcggaaatcttctttcgatagatccttgtagcttacgatataccctttctcttccagcttatccagaatagagatatatttcacgcgatcgtacttgaccggaatctctgtgatcaccagtttggttttaccctggagttcatacttgccgtaaatcgtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcggaattgttaaatcctcgtccatgtagatagccttgaacagcggagacagcttacatttaatgtagcgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgcacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtcagcatcgaccatgatcccgatgttgtcgtaagtcatttcggaagagtcgcctggatggagattcaggatcgccatgagttcagacaattctttgtttttgagcacttctaagttactcattccccaggtgttcaacggtttaccacgtagcggaaatgcgccttgtgtctcttcgtttctgcactcgataaactgccccacggcggaatcgccctcggtcagaaacaaagtggtttctaccccgtcagtgtcgatccctgatgccggaacatgttttgcaaccttcgcctttttagctttcttcttcgctttggtaatggctgcggcttctgcggcctgtttgcgaatcagagcggactcaatgatcggagtgattatttcagaagtatccataatctgtttcgcgatctttttatagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaatggcagggaaagccactgcaagcgccataaggcgatctttgatgacttcctttgtctcttcgtcgataccgtccacgccgaagatagagaagtcaggggtaaacttaacggttgtcccttgctccttcgtcgggctggtgcggtaatccatgttctgcgccccgtccgtacagttgatcgtgactttgcgtttaccgttggatgtctcaccgataaagatcgcgctgtaacagtttgtcaggaaagaacctacaccgttcatccccattgttacgcggttttcgtcatcgaagttagaaccggatttagccattgtccatgctgcaacaggtttaggaacaatcttcccttctggcgttctcacgtcatcttgtggaataccgcgtccgttgtccgaaatagtgaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatatgatcgcggtcgctcaagcagaatgattcatccaccttagcgccctttgctggggcttctggtgctttctgcggctcgttatcgtccattaagaaatctaaactcatattcacctctttattagttctcaggcattatatagggttctatgaaaaagaaaacccctttcggggtttacttgttgtacgggaatccgtctttcaccatctgcggcttatcaaccgttcgtttcgcctcgcccccgcaatcacaatctttcggttcgtcgcggcttgcgatgctggacattttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgtcgtcccgtgggttgtactcagtttcaggtaaatcacatccagggcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggatcgtaatttcagtttccggttctggtgcaacccataccggattgaaaagccctttcatatcgttgaactttacaggaacgggaataccttcaagataaagaatccctgtttcttcatacaccatactgatccggcgtggtgaattgaagtccatcggattcttacgcaacgcgtcatacatacgacgaatcggatcggcttctgatgccatttgacacacagccattaaaatagatttcggggcgtacatatcgccaactttatacttgctcatttacaatacctttatgataaccaacaataaaacagttcacttctggacgttcgccagggaaatgcacacactgcatgacgcgttcagccatgagttcttcgcccaaataaacagaggtggtttcttcgttgtaatgacaatcatacgaagtcttaacactcataccaggcaatccggcgatatgcataaactttgagttcgtgcatggtttaccctcaatgttctttccgtttacatcaaacgttgcaaacatttcggttttgctgttctttgggcgtctgctcatttcttcacaacctcattatatgttgacaggttccattcatgcacttccggcactttggagtaatgatccaggaatactaactggacttgcataacattagcacgatccatattgaaaaggaaacgttgcggggaagtaatacacaggaaatcttcggtacttcctctgcttgcgctaaactcttttgtttctccgccgtcaaatttagcatagactggcgtagaaaaatacggggcgaatagttcgcgtttggaatcgtccgtaatcgcgctgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgttgttttaacattgcttcgtgttgcgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtaaccgctacggtcgatcgcgttctctgggttgttgaagatattaccgcgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactatatcaaagctatcccgtgaagtctttagcaaaaagtgctatttgttaaacccgtttcccttgataccatttcgggaaaataacccggtcaataaaagttctccccaagttgaaactatcaccgaacaggagaacaccaaacaaagggtcgtgcttgatatcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccattgctaccgcgtcgttttcgttgaaaccgttcttaaccaggactttaactactttggcttctaagtttttcatgatgcgttccttttgtctgtttcgtttcgatgtgtgtaatatactgcatatcgaaatttgggtcaatacccaaatcaaagaaaatcgtatttttcttttaatttttcgtaatacgtatcccatgccgcttcgtcgttgatgatctcagtaccgaaccgataagcacgtttgcgcagttcgaaacgttcacggatacgctcaacattgattttcactgattccggcgttggttgccagtccgcgcacaaatgacgatgaaacagggagtttgacagcggactaagatcgaaatcttcgtatgcaccgtccatgtattctttaccgttacgcgtgaggtattcagcacgtaatgcaacatgacgatcgcgaaggtatcccagcttattgtaaaagaaggttacgtgtccggttcccagcgtatacacagcagggatttttgacaggttgatttttgccttaccggataaaacggcattggggatgcgagggagttcgcgcagttctgcgatcaggtgttcgttcagcagaagagaaggatcgattgtgttaatacgtgtcatagttgcctccttttggtatgtgcgcaatatacaaaaaagcctcttgcaatgcaagaggctattaaaattattttgccagtggtataagcatctttcgcataccgccgttttgtgtcgcatcatacacgcgtttagcttcaataagggaaagttcgatatggtatgatttccctttcccgtcaaaatcaaacgttactgtgccgcttgctacgcttacatgagtaaagatgaactcaccagcgaaatgctttcgaaacgctttgtcgtgatctaggaaccattcaaacgcttctccgtgctggtacagtctgacgataatcattgaaactatgacgaaaatcagaactgctgcgacgatcgtaagttctttcatcacttacccctgtttacagattgacggtgcagcacacggttaacgcgtggtgcttgatacggtttcattttgtacggtgttggaccagagtattcgatccggttcggcattgcgtacagttcaacgcgtggttgaatccagcggattgagtcgattaacccttgagttaacgcacgaccgaaacccacaccaactaaacataaacgcataatatccccttactgtgccagaatgtgaagccattcacctaaccacacgatcgcctgataagacaaccacaccgcaccggatacacacgcaatcacaccaatgatcgcaaatccgattaaaatgttcaaaccttctttcaaatcaccaaacatgtttcatcctcttttgtttcagtccctacaaaataacaaagcccctgcacgaatgcaagggctttttatcataattcgactaactgaggcaatttcagaaccatccccggaaggatatagcttgcattactaacggttttacggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgcttttgcttcgttcagtgtttttgcatgtacagttttacccacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgacatcaaccaggataccgcgatcgaattcagggccgcgaacgtaatcgagtgattgccaacggctcacaccgtccgctttcaggtcttcgaagaattgtctgtgtcctgcatacagttccaaatcctccggcgacggtttcaggattgtacgggcttcttcgctttgctgtttccaccaatcgatcgttgatttgtcagcaatgcgatccggttgctttttcaaatcgaacttatattttctcccccgcgaaaccagttccgcgaatgttggcgggttgtgggggtcgtcgataaacggaacgtaagacagttcaacgagtttaccgtttggtgacgggcctacagtttcatagtcccatacgtaatcaactggaagatgtgacattacgaatcctcttatattcttccatgaaaccagccagcgcaagggctactctgggagtgatatcaaactcactgatttcttcgttactcagcatctgcataccgaattgacgcaaaccacagttatatatcgactgttcgagtcgctttgtattttcaacagcttccacgaattcacacagatagtcataatcaacgtgtaacgggatttgctcgcggggtgtctttaaaatcaggtcagcaatcagatccgcatgaagacgagggaatttcatagagatatctgttttcatggtaagtaccacaggtctttgttttcgcgtaagttacgcatgacacgaagaatcatagtaacaacaccatattcttcatatgtaagttcaactgtaagggcgacgttaccccatgaataacttggcccattagggcaatacagatttttattgtagctgtcaatgtatttcagcttacggatcacatcagcaggatcgatagtgctgtacattgcaaacatggaatttgcatgagggtctttttcgcgaatcttttcgactgcgttcagaatctgctggatgtcggtaactttgatactcaatttcataataacctcataggggccgtagccccttatacatagtcaacggtgtaacgtgcgcgggttacgcccacatagattaactgcttacacagatcgtaatctgcgaacgcatacgcatcgcgcgtgtacatgtacgcatggtcatacgtgctcccctgcgatttgtggtacgtgcaaaccggaagaggtttaacatcctggaacttgtttttaatcgcccagaacgaatgccacggggctttataccctgtttgttgcttgatgcgcttataagtgctcgcaacgtaagccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaaaactcggattttttcgttgttgttataaacaatctcggtgaagatttgcccgttcaaccgcatttcctgaactaacggttcctgcatcacgatcacttcatcgagaatgaacggttctgttgttttgtacaggtgtttacggatcgttgcgttcagcttgtccacgttgtcgttagtgtacgcgaacatgcggttctcgatcaagtcatccggcgttttaacacggcggaaatactgacggaggaagtcaacagcgttagcatgttggaacacacccagatcaccgacagacatcggtttcagcatcttaccatcgcgtacagcgcgtgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggataacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcatccggcgtgtagttcagtttggtttcgtagcacttgcggataaaatctaatttatcttttgcaagttgcggtgatgcaaacagttccggcgttttcccgttttcaacgtatggaatagtaaagccgtctttgtctttcgtaacaatgatatagtatttgtcaatcattttcgcccctcatagatgacgtagaaaaaacctataaaccatagcaatgataatactatcaaagcggcttttctgtcaacaccgttaacgtggaaaacgcaccaaccgaagagatacgttatcaccgcgcagacgatataagacaaagcaaatacggcatgtagcgcggcgatttccattagtagttgttcgcccaacgacgcaggttttccgcctgtttcagagcatacagcttgtagatggtttccgcatccattcccagcgcgaggaacttacacatgaagaagtgccactgatcaatcagttcaaacaggatttccagtttgtcttcttctttcatttctgcgaatacctggctacgcagttcttgatgatttgctttccacggtttccatacaccggaagccgcttttgcaccgcgagacataccacccagagcggtgtaaagttcgcgggtttcatctgcaatcgcatcatcttgcagtttcagccagtccaagatatcaccgcacgttttcaggttatcagggcgcggaacccatgaaagggtatcagacaggctttgttgtgcgtggttttgcagatccagcattgattgcagaggatcgccgttacgtgccagaaccttttgatattcggtatcaacaaattccagatcagcagggttaaccaggtgcgcacatgatgtaaaagtgtttttatcagtcatatcaatctcattttttcggtgatttgttccacgacttaaaccgaagtttcgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgtggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtataatcatccgggtaatagtctttcagaaacacagaaaacggcttgctgtagttgcagttaaaacaaccacacatcatatgtgtgcctcgttttgacggaaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgaagtttttctttcgttcgtgtacacgatcgcggtgtcgctcatgtacttgatacggatcggaaaccaggtgtaattgttcgcagtaacccagatccggtaattcaaaggcggtaatggtttcattcttcactcttcatgattttacgtttgcgtttatatggacgcgtagaacccagaacctttggccctttgttcgtgatcgcgcctgtagtcacacccgaagcaatgttatccacgcttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgtcttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcagggaattccatacagacaacttcacacatcggcttcacgcctttccattcttccagatagtatccggtatcaataccgcaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaatcggatgtctttatcttgccgaaaggcggattgctgatcgccatatcaaacatagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaacgcgcccagttcagagttattcgtaaatgcaccttcatggaagttttcgataatgaataacttttcgtcgtaggttagcgccttatcagactccaccagatccattatcttgttgtgttgcttcgtttccgctttcgttaactttgccattgaccttttccggtaataagaacagaggggtagattctaccacatcaaagccccagtcatcaacaatattgctttcccagtcgcgggtttcccacgggctgcaaatccacttatacaccccagcaggatcttcaacctgttcaggcatacccagcatttccgcattgataccttcgtccagatagccaggatgaatattaggccagcgcatgatatcgacatagcctttatcatcaaccgatacgatccattcggaacgatacggactatcgaactccggttcttcgtctggaagtatcatatctaataaatcactcatttcactaaaccttctttaacgccctctttcatggctttcagaacaccgataaaagcgtctttgccaccgatagcgccgatgataagcatcaggacaccaacacaacccgctaaaccgattctgaacaggttccatgcaaacgggatagccagaagcactaaccacgggaacggaaagcccataagtgcgtttagaaccagtaagataaaagcgattgcaagtttcatgatgtcctcctttgtttgtttagaataaggtatcacctttcgagaaggattgcaatacctacagatacaaaaaagcccctttcggggcttaattttatgctttgttgattagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccacaacaaacagcacccagaaagccagcttaatcacaccgatcacgatcagaggtgcaaacacaagccaccaggaagcatttgccataaccccgattgctgccagtttcagagacaggaggatcaggaacacaataacgagaatctttttcatttcactatacctttggagggggccgaagccccgttaaaattgaatgtctgtgctgtttgctacttcggctaacttactgcttcggttagtttcagcttgttttaccatagcaccttgtgcttcttcaagcgttttcggcatctgacgacctttataatcagatttgaacccgatatcgctgttgtcggtatccatccagcgttgattacccttacgcacttcgagtttgaagtggttaaagtggttcttatcgccgtaacgggatttgatctgcttgaacaactgcaagccctgatcagctaactcgtcggtctcaatcacagctaacataaagtcagcagtagccggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaacccttcttcaatttaagctctttaatcagcgctttgaagtggttcgcgttcgcccctgctgttgggtattgcttaacgattaaacgtccgaccttcgactgtttgaggcgttccatacggttcttatagtccgcataggtaatgttcccgttgtcgatatcgtcaagtgacacatcaagcaggttagcgtcaatacgtttagaacaaacgtgttcagccatttccatactgatatacaggacgtttttacctgattgcaggtaatcagcagcgagagaacaaagccccaaagatttaccaacgttaacaccagccattaagatgttcaatgttccacgttctgcgccgcctttggtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcaggaattgccccaacgtcagggattttgttgttgcgttctccagcaggtttttcagcattcgcctggatctcaattgcacgggacagagcgcgatacattgccttgtcacgacaataggtttccgtttctttcatcaaccagtccagatcttccggcgcatttttcatgctgcggatcatctttttggtgtcttcgtagactacatcactcaggctctttttgtccagagctacttctaaagcagtttgtgaaggaatgctgttgaattcctgtacgtgcttatccatcaaatcaaagagaacttgcgcgttcccttcgaaatattcacggcgtaaatggggccacgcctgaacaaaatacgtaccattaaaaaccagatttgaaaatattgtttcgacgatcattgttacctcttaaaccagatttgcgaacatctgaaagaaattatacagctttactttcaacgccgcccataaggtcttttcaggctttgggagattaggcttgatctgcgcgtagattgcatcgtgaaccagcggaatcagtttttctttatcttcgtccggcgtactgaattcgactttcaagccgttatcccaatacactttatggatgtacactaagtgtgcaacatcgttttcatcgttgatcaacagttcttgaataacgtcctgcattgcttcatcaagaatgttctttgttttttgttcaatgtccatgattcacctattaaaagggggcaaagcccccagttgtttattactcttctgacatatccacatcatcagggatatcgtcatccaaatcaaatttatttgacggttctacttcatcgtcagaataaagatcttcgagtgctgccccgtcagtgatctctttgtcaggaatacggtatttttcctgaatcgcatcaaggaatggctggtgagtgaacagaggtttccagaactcaatagagttggtttccgtttcacgccatttcttatcttcaacttcgagttcgccagtctcggtattcaggaaagcacggttgcgccagcctttcgttacggtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgttgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcacgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctccgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaaccacatgtttttcaaataatccgccatagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggaagccagcaccatcattatattttgagatattgttagcagatgatacaccagctatttctcggtagtcaagcgccttatactcttcttcaaatactttgaagtgttcgtgtaaggattcttcaccttcttgcaggatgcgacggatcgcttctttcaagaactttttaaccgctgtcggtgtactgcttcgctgggtttccattcccatgatctttaatttaggcttctcgtagcgggttccttcggagtcccatacgttagccgcatatcgtttcttagccgtccagaaactacccagacctttcgatcccagaggtggtccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtagtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcgctgaaatcttcgtagaactcgaaatcagggttgatcatttggttgtgcgcgtctgtcaggtgttcgagttcgtgcttaatcagttcgagatttcgctcacccgccatcattcgttttttccacgccttacgctgatcaaatactttcttgatctcgaccggaatcacgcctttaacatcgcgtcggaacatccacccgttaggagagcagctaaattcgtcgctaggacgcggcgcagtcttattgatgtattcatgcatcggacgcactgcaaagctgttagcgattgtctcagggcttatattcacctgtcggatgatagatggatacaggctggtcaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggcgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgaagttcagacagcgaaccttcataatcaactttgcttttacctgtttcgaactcagcgatcgcacccagagagtaagacggttgcggggtgaaactgaatttcttatagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcaatatcgaacttgtttgagttccagcccgtaacaataacaggcgtccgctctttccagtctttgatataagccgacaacagcgacttttcggtctggaatgaacggtaaacaattttcttcaagtcttcttcgctgatctcgttttcggtatcaactttcgacgctacccattcatctaacccgccctcgaccagatcgtacacaaagaatttatcttcaacgctgtcatagtgtgtgattgcgtcgatagcatattttgcttcgcggggatcagggaattcaggcgcggtaacttcgatatcaagtgaagcaatgcggatcttgtcgcggtcgtattcgatttcctttctgtaggcatcggatatatacgccagcctgaaatcatccatgcctagcgcttccatgcctacatctttcattcgctgcatccagttttttgcttctttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttggtcagatcaagcgagcgttgcgctaatttgtgatagcgttgggtgtcaggccgatttagttgttcaactagcacggtatattcttccatgatgcgagtatagaacttagggaagtgatcccgcgcgtatgcgtaggtgcgcagatcagagagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgaccgatccggtacttgtatttcaaagtccattcagctttttgtgcgtgagtcagtacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacaacattttctttttgttatttgcgatcccgatgcgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacatgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggaatcagcgtttcgatatgctggctcattgcattgtcgatgaaaaacttatcgtatgaatcaagggcagagatccgtaatgatgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaattactggtgtgatatccgaaccaacaatctcagacagaataccagcatcaattttgccgcgcttagaatagaacccaagagctttaacgatggatcgcgcgtctgggtagtgcttcttaacgaatccggcgatcacctgctggtcatattcgattttctcgatttcgaggataccgaaacagcgtttgatcatttgcttcatcagttcaacgcgttcttccttcgacggggaaccgaacttgactaccggacagcgggagatcagcgcagggtgaatcccgttgatgttgttcgcggtgatcataacagtaacgttcttgctgtacgcttcgataaagctacgcatgtgcttctgtgcttctgccatgcctgggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgattcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactgctttgtttatcttacttgaactgactggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttccacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcaatccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccagatcaaacggaggggtattatcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggtcacagcaacacctggttcatccagatctgggttccccgcgatagccgcagtgattttatccatgatctttttaccgaagcggaacttaaacaccttaccttcgttttccgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttaaatgtaaacctttcggctaactttttgaaaaaatacttatctcttctcttttcgaacgctttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattatacgcttcttcgattgccgttgcaacatctttcggaataaaatcaaagtcgcgaagttcttcgttttctctgtaacggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttaatgatcttcatgcgcaaatcgttacgcggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcactacaccgatcacgtcatcggcttctgcgaagtcaacgcggatacctttgtacggtagattagcacggatttcatcgtatgtcgggtgaaggaaaccattcagacgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatattttttatattttatatatagagaaaacagtacatttccgtatactttttaaccagatctaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggactccatcaagggtacacgcattgaacaggaagccctacgcaaagcgcaaaagttcatgcggaagaacaaggcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtcgagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcatcgacgaaccgaccacggttgatttaggtggcggaaattcgattgacctaatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgacaacgtgttttatatcggtacgcctctgactatgagcgcgaacgacgaagacgaaacacgcggtttctatgtgtttacgggcaagcctgaattgactttcatcgctaaccctgtgtgccaccatcgccggatcatgtatccagcacagaaagatgttgatcttgaacagttccgcaactgcgcggtgcgtctgattgttagtgaaattgatcaggggcttgcaaagttccaaaccaaaatcgaagaaattgcctatgaaatcaacatcatagacaaagttaaaacagattcagatgtcgataccgactttgaaatcaaaaccgttcgtgggcttatcactgagtatatcgccaacatgcagatcaccgacgatgaaaaagaggaagtgaataagctgatcagcgaactctacgcggaggtgtcaagtgcatagccgttatgatgaatatttcggggcgaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaactttaagaaaatcacgtatcaaaacattttgtcggtcgggaacaccccgatcgaactgaattttgatacggcaaagaaaactctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagttgtgcgcggacaaaagccgaaggtgttcgagatctggaagaacggcgagaagttgccggaagactccgcagcaggtgattatcaggcacagcttgaatctatgctgaacatcaaccttgtgggcttcaaacaggttatcgttctgggtacagcgggttacaccccattcatggaactgaaaaccccagaacgccggaaactggttgaagatttgctgtctctgtccgtcatcagtgaaatggataagctgaacaagtcatacattcgcggtgttaatcagcagttggatacactctcaatgcagggtaatcacatccagcagcagatcgcaacacatcagcgcttcattgacgaacagcgagcgaaagcgaaccagaacaacgcccgatacaaagagatctacgatagtcacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagagcagtttaaaaagctggaggtgatgtatcagaaaggcggtgagtgtccggcctgtaagcaagcgattaaacccactcctgagcgtatggcggagatcgcagagaacatcaaagcgggtacacagcgtttaaccctgatcaaaaccaaacaagacgagttacaagggatcatgaatgacttgcttcaacagcaacgcgcactcaatgccctgaaaaccaaatatgaagccctgaaaggtacactgcaaaacgaagttgccaacgctaaacgagcacaggcgatcatggaacaggcaagcgcggaagtagtcattgatgaagaacccgtgaagcagttgcaacagcaggaagcagaactgaacgaaaaacgacaaggctacgtcaaggaaaaatacattcgtggtattgttactgatatgttgaaagattccggcgttaaggccagcattgttaagcgctatattccgtacttcaacaaacagatagcatattatctggatctgttgggtgcggattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatggaccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcaatctcatgttagaacgtgaatttgatttaaagacctctcccgaagtggagaggttttatctccataatgaactattggaagaaaaacatgtagttacaatggcagatgttgaggaagcattcaaagataaccccattgaattgacacgcatcaagaataataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaagcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcgacatatcgtttcacctctggtgatgcgttctttgacttctctttctcttgtcaaccgccgaacggtcaaggtttagcagcgccggacgcgtccgcactgggtaacgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcaccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaatactaaatcactgtgttatactgggaactgttgaaaagcagttcctttttttatgaggaaaatactatgagttgtccaacatgggcgcactttgaaaacctgaaagaaggtacgcaaaaacgcgtgtttatcaatctgggatggttcgcacctacagattttgacattgctgaaattctggttaatgccagtaaagagatcagcgatacttacgaatgggactgtgtgagaatgccagttctaccagggcagtttattgatcgcgagaagttcgaagcaatgcggatcgccgtcgaaggtatcaattcgctgcatcccccaagtttgggtatgcattaccgccagcgttttaccttgaaaaccgcatggactaaagataaagaatgggtgaaagtatgattattcaggtatcggttcagggaaataccctgacagtaacaaattccattatgaccgctatggctgcgtgtcgtgatcatgtgatgtcaaaccctccggtaacggaaattctggaaattgatgtatgggaagacggtgtgatcgaagaatcctttggtttcactccgttagaggaagatttacgtaaaatggaacaatggctatggcaaactgtaccccaatgaaactaccaaagcacacaaccctgttaacccgcgaaaaacttcattctgttgagtggagtccgttagatgtgatggtgttcgatctggaatccaaaatcattaacgctcatgttaacggattgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaaatggactatgctttcggttatgaacagggtttaccgtggggacactgcaaagaggatttacagaacttcaaagcagaaaccgcagatagcgtcctgatcatgggtgcgaacacttttacttctctgcctggtaaattgcaagggcgaatccattgtgttctgtctggttctggtagtttcctcaaaaccaaaaaaggcgatattgctgattatgtcatccacggcggcgggttgtctgctgcaatcgacgtgatgaaagcaacgcatccagatcgtgatgtgtgtctcattggcggtaaggggttgcttctggaagcaatcaataatacactggttgacgaagtggttgtgacgcacatttacggacatcacactttcaatgcaccagcttttaaacgtgatgtttcgttcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtacggaatcaaccgatcgtactggtgttggtacactgcgcatcttcgggatgcaagcacgttggaacctcgcagaaggtttcccagcgactaccagcaaacagctattcttcaaaccgtgtaagcatgaattacaatggttcctgtccggttctaccaacgtggaaacactgcgtaaaatgacgtggggcgaagatagcgataagcggacgatctgggacgataactacgaaaatcaggctaaagcgctgggttatacgaatggttatctggggccgatctacgggcatcaatggcgctcgtttggtgaagaaggtttttacactggtgtcgatcagattgcaaaaatcatcgaacaactgaaaaccacaccagacgatcgcgggatcatcgtttctgcctggaaccctgttgatctggatgatatggcgttgcgtccgtgtcactgtttcttccagttcgtcgtaatcaacggcaaactgtctctacagtggtatcagcgttcagttgatgtcttcttagggttgccgttcaatatcgcctcctacgctctcctgacgcatattatcgctgatatttgcgggtatgaagtgggcgatctggtttggactggcggtgatgtccatatctacaaaaacgcagtagaacaagcgaaagagttgttgaagccggaacgcgcaccgcttccacttccgacgctcgtaatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacggacagtttgacccgattccgttctacgaccacatcgctaatctggttctcgctgggaaatacgataaagaaatcctggcaaaatggactccagcggagattgattatctggaatcgaaaatcaatcacgataaagattttgaattttcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgtggttgacttctataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgctggtattggtgtcaacgccggacacattcgcgctatgggttcaaaaatccgtggtggtgaagcagtacatacaggcgttatcccgttctggaaacacattcagacggcggttaaatcctgttcccagggcggtgttcgtggtggtgcagcaaccctgtattatccgatctggcatcttgaagttgaaaacctgttggttctgaaaaataaccgtggcgttgaagaaaaccgtattcgtcacctggattatggcgtacagcttaacgatttgatgtataagcgtttaatcaataacgattacatcactctgttcagccctgacgttgcgaacgatcgcctgtatgacgcgttctatcaagcggatcagactgagtttgaagaactgtataccagtcttgaaaaagacccaacggtacgcaagaaacgcatcaaagcggtagatctgttccagttgcttgttcaggaacgcgcacagaccggacgcaactacattttcaacagtcatcacgtaaaccagcagggtagtttctctgttccggttcgtatgtcgaacctgtgctgtgaaatcgcgatcccaacttcaccactggatgacgatgataaactggctggcgaaattggactgtgtacgcttatggcgatcgttctcgataatgccgatataagcgaattcccagcccttacacgcatcgcagtacgcgcactggataacctgttggattaccagaactaccctgttgcagcggctctgaaagccaaacagcgccgttctctgggcgtcggtatcaccaactatgcatcatggctggcaagcaactattgtgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacccccacgcggccctgtgagtgtgaaatcttcgaaagaaggttcattcaatcaggtagtaccaaaccagaataatcagattgacttctatgattatctctggacaatggcaaaacgtggaaacaaaggttatctgtctcatgtagcggttatgcagaagtttgttgatcaggctatctctgcaaacacaaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttaataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaaatcattttcgattcaaacctgcaatatcaaaccctgctggataccattcaggggcgcggcccgaacctggcgttcctccctatcgcttccgatgtctcaatggaaacgtggatcgaaacatgggcgttcagtgaaacaattcatagccgcagctatacacacattcagcgcaatttacacatcgacccgtcgaaagagttcgataaaattctgcgcaacgaagcgatcatgaaacgttctgcttccatgacaaaatactacgatgatctgatcgcagaatgtcatgaacttaaaaatattgtgctcaaaatcgaaatgttaacgtcccacggatacccagacgaatcgatcgcagagtacgagaagaaacgcaaagagcaaatgcgtaaatgtaaggttgctctgtacctgtgtatgcacgctgtcaacgctctggaagcgatccgcttctacgtgtcgtttaccttcacattcaactttgccgaacaaggcaagatggaaggtaacgcgaagatcatgcgtctgattgcccgtgatgaagcacttcaccagaaaggcactcaaagcaagatccgactctggcagatgggtaaagatgacccagaaatggcggaaatcgcttaccagtacgaagaggaagcgacacaaattttcctggaagtgtacgaacaggaaaaagaatgggctgaacacctgttctctatcggtgatgtagacggcgtatccctgaaaagtacgatcgcctatattgaacacctgacggatcagcgtatgcgcgcggttggcttgcagtctccatttaaaccaacgccgaacccgtatccgtggatgaacaaatggttgaagtctgacaacgtacaggtagccccgcaagaggttgaagtaagttcttacctggttggcaacctcaacactgagatcagcgacgaagcctatgcaaaatggcgacaaaaatacgcttgattgtcgcgtcgtaaacaagtataaaagtgattgggatgtcgatattcaaagaggtacgaagttcggcaatcccttttacaagggaacacggggtgaaaacattcttaacttcatcccgtatttccaaaacttgattcgaactggcgtgatcacaatcgacgaactgaaagaactggacgggaagcggttaggctgtagttgcaaacccttaccgtgtcacggtgattatattgctcactgcgtcaatgtgttgaccggaaaggtgaataagttggatatataatggacgatgtaacgtttggtgtaatatttcctttgcgtctgggttcagacaaaaggatagatcggagttttgttaaatgtggcgaattccggcattgtgtgtattttattgaaatcgacggtcggatagtgtatgttggaaaatgtcgtgatttgtggaagcggttagacacataccgcaattcgaaatactggcgggaaacaaaccccagtaacattttgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaatctaaccaaaaatcagaaaaccttattcaaccagttgatgaaactgtgtaacgaaagcgaatgcttctacttcattgatcaaaaaactgtgatgcaaaccaatgttcgcatctttaactatcgcatggcgagctattccgactggttaaaacctggtgcgctggaatgtcgcggcatcatgtttgtaatggatggggatacccccgtaaaactcgccagtcgccctatggagaagtttttcaactatgctgaggtaaaggcatgggaagcactgaaagcctctcctgtgacgattggtgaaaccgtagtggatgtgatgattaaggaagatggttccctgatctccaccttctgtgattccggctatctgggtgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaaatcaccgatctggatgcgttcattaccgaagcctacacgaaagaaggtttcgagggttacgtgatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgccctgagcgctgacttaacccctgacggtcgtatcatcttcgggcctatgatgcgttatttcgatgataccgataagcaaaagctggtcgataacatcgttgcattaatggcgaagaactacgaacagtttataccggaagaatataaatgacattaccagcctttccaaagttaacttctttggtgtggcctgtcattgtagccctgtctttggcagggcttttgtacatgacaatcacactgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagatctgctgtttaaaaaaccaggactgatcgaaatcaagatcaacaagtccttcgaagagtatatggcggagtacgacaaatgaaaattgcaacgttagcccttgttctgggcgttctgttggttgggtgcgcggagaagccgccagaaaagattttgcctacactccccgctaaggtgaatccggttaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgtaatgaatctgtttattactgtaggtgtaccaggtagcgggaaaactacatgggcgaaagaaaaagcacgtcaactggggaacacgctgactgtttcccgtgacgatatccgcaaaaccctttactgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaagccgaaatgtgttatcttcgacgttgacgggacactgaccaaagttggacaacgcagcccgtatgacttcacaaaggtgatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgagaagaaggtgatcatcgtcacgatttccacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattctgagtcaacgtaacatcgttgaacaacagttcgggattcagtggaatccggtaactaaattcgtaacatgggcggcagtattatgagtgacaaaatcagaaagattcatcaggcatggctctgtactgaaccaacgatgcttcgttatggttgtgtgtttgggttggttgataatgatcctcaacaggacattgcaacaagtccggttgttgaatacgcgattccggcgaacaaatcgtttgttgaagtggtgacacgttcaggtactacgtatcacatcgtcaaccctgataacgatttcatcaaagacattctgaaatatatggatgaccgttaatgaaattcaaagtaatgaatatgctgagagcaatcgatcggagtcaacgttctcaatgtatttcgaatcgtgtaggtgctattatcgcgattggtggtcgtgccgtcgcgtggggcgaaaataatacggttgaccttgattgtcgttgcaactcatgcaacaatcatatggtgaatgatgacggtaaactgaaagcggttgatcgtcctgaacattcagcatggtcaaacgataacgaaattcatgcagaaatgaaagcgctattgagtgcgcacacaagaggtgttatactcaaagacgcagcactttacacaactgcatcgccttgccctaactgcgcgaaacatatcgaatggtatgttgctaacggggcgattacatcggtgtattatctcgataaatacgatcgtggtaatgatgaatggatttcacgcttgcagaaatatggctgtgtcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatattccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgttggttcgcgagatctatcgcaaacagttctaaaaattccggccctttagcttaattggttagagcgggtgactcataatcgcgcggttgctggttcaagtccagcaggggccaccaaatacgcaggtgtagttcaattggtagaatatctggtttccatccagattgttgagggttcgagtcccttcacctgctccaattcgggtgcgtagcgcaatgccgttaaatggttcggaatatgcaaccttatcgtatgcgataggctctgttggtatccggtaataggttccccggaatgcggggtgaagtaaagaaacttccagcccacaaatttaaaagagaaaaatatgaaaggtcttcaaaagctgtttgagttaaccccaaaaattcgcgaaatcgtcgctgcatcaactgaaaaagaaatcaacggtaaattgatgaaactgtttaccgaagaaatcactgatttcgataaagaatatcgtaaagcgttcgatgcgtattctgttgatggtttctttgcatcaccgcaggtgaatagcaaacacgaatatcatcgacgattctttgactggtcgatcgtcaatatcgttcgtcgaactgatatcgaacctacgaaccatcagttgatctctatagattcttctgtattctttatccagtaccttatcactggtggatttaaagcagaaggtatcccgttctgtaacgaagctctggaagaagagttcgcagaagcgtataagtatatcaaagcagttcgttaatcaacaggctatcttcggatagccttttttctggagaagcatatgcgctttttgaaatacgcaagctggcttgtactggttcccctggatattctttcgggtgttctggctattctgctggctcctttcgtggttccgttctacagtgacgaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaacccgaaaacagaaggtggttccgatccttcgcgtcacggttatctgttgatgtggaatgattcggcatgggggctttatgtcttcaaaccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtggtggtatccaaaaccctcgaaatggattcagtgatcggtaaagctcgcgttgctccattcgcaaaacgtgaagttgatattgaatttcaacccactgttaaagtggaaggtggacaacacttaaacgtaaacgtgttgcgccgcgaaactctggaagatgctgtgaagcatccagaaaaatacccacagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccgattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcataccctatactggaagggtatgccgattcaccgtgaatcagaagcgtatcaaatcctgattgaaaacgcgtacaatgctcttttcctgaatgacggtttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgattaacccgttggcattactccacgcacagggcgctttgagttctaccctgattatgggtgttatctacaaagcgggtgtgtattacgttaccatcggcgcaaacaacatgaacgtgatcaacagctacgttgaaaaatgtaagctgaaagatattgtgttcgataaagtcgaaatggatgttcctggcttcgacgctgtttatatgtacaagggttgatgatgggttacgtaatttatttcgattgttcggatcttgatccgttcgttctgcaacaggcaaagaaatatcatcaagatatcactggtatcagtgtcacgaacgatgatatgttgtgcatcgaatttgattattatcgtacatttgagcgtgacaaattccttgcggatattgaagcgtttaaaagtacccttttctttgatcgttatgaggttaaatcttgaaaccagttattcttaccgacattgacgggatcgccgtaaaatggcagtcggggttgccgttctttttgtctaaacacaacatgccgaccgatatcgcgctggatatggttacggatgaaaagttccgcgatatgaccgaaatcttcgggtgtgatcaccaactggcgaaaattctcatggaagaatacaacaacagttcgtttattcgctatctaagcgcgtatgacgatgcgttgattgtgatcaaccgcctgaaagcccaatatgatttcgtggctgtcacggcgctgggaaccactcctacggcaagccttaaccgtattgcgaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctaaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaatgcagcccgtgatcgtctgctggatatcgtatcatcggtgaacgagaatgatcgcgaagttcttcgccgtatcattaaccgcgatctggaatgtggtgctggtacaacgttaccaaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgctggaagacaagatccgcaaagcatcccgcgcggggaatgagtatgaaggtttattgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggcactatcagcgacgaagaacagcgcaatatcgtttatgttgtctgggatatcgtaccgtatgaagtgtactatggtgatgctccgagtgttcaaccatattgcgatcgtttctctatcctggaaggtgcgctggctggctctggtgtaacatcggttaagctgattccttctatcctggtgcagaactatgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgatcgaactgcgaatcatcgacgtgtatgaacacaccaaagaacctcataaggttggcgggttcgtggttgaggacttatcaggagaagccagaacgaacacaggttccggtctgactgatacggactaccgatacgatgaagacggtattcaccgcgtgtacatcccgttagaagaacgtggtgaactggatcgcgaatacattatggcaaacaaagatgactatatcggcgctatcgtcgaaatggaagttgacggactccagaaatcgaaaacgcgtaagaagggcgaaccgg

SEQ ID NO: 154 - DNA, 178722 bp, Unknown
  source: /note="Description of Unknown: M16-6c Bacteriophage Sequence"
tccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcagaggcggtaatggtttcattcttcactcttcatgattttacgtttgcgtttatgcggacgcgtagaacccagaaccttcggccctttgttcgtgatcgcgcctgtagtcacacccgaagcaatattatccacgctaccgcctgaatcacctgcaaccatttcttcgttgagtctttcgcgaagttctgggaggttcatcatgatctcttcgtgctcttgctcggtcaggttccagcggctccgtaacgagtcataagcgcttgtaaggttcatgaacccagacatataaggaaccgcgtttaaacggcgcttgatgtgcctcacagagcgatggaacggggaatatgcttccagttcttccttcgtcttcgggtttttcaatacttccccttgaccgtcaatgatccccagcttgtaagccgtccattcagtccagggttttttcagtaggcgaatcattcgcacactgtaggttaaatccatgtttttgattaattgatcgctcatagtctttactctattgtgaaagtgaaaaggttttgcgcgggtttggtttctggttcggggaattccatacagacaacttcacacatcggtttcacgcctttccattcttccagataatatccggtatcaatgccacaacctggttgcatttcaaggccagtttcatcaagaaactttttgcatttcgatgttgtcgttgattcgtcctgttggaaataacgccgtccagagtaacggaaattcgcggacatctgcgggagaatgaacgtacccgcacgggcaatctgtgaagcacgttcaatcactttatattcaaattccgcgcccgtatacttacccttaaaatcggatgtctttatcttgccgaaaggtggattgctgatcgccatatcaaacagagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaagcatcgcgaacgatagcccaccaatacccgcacacaggtcaacaacgcttccactggtacaagcatcaatagtgaaatcgcgagcaagtccgatcggggtaaagaacgcgcccagttcagagttattcgtaaatgcaccttcatggaagttttcgataatgaataacttttcgtcgtaggttagcgccttatcagactccaccagatccattatcttgttgtgttgcttcgtttccgctttcgttaactttgccattgtcccagctatacagtaatgttgattcattcgggtagaattcccacccgtccacgtatccggtttcccagtcagtagtttgttcgaaaccacagatccattcgtacacacctggcggcagttctacggaatcaggaagcccgatatcttccgcactgcgcccacattcaaaaaatgcatcgtggatgaacggacgagataataccgtaacataaccttcatcgtcaacagctacgatccagcgcgaactgtgaggactatcgaacttcggttcttcttcgtctgcatcagcttttatttcagccttacaaaaatctaaattcatcatttcactaaaccttctttaacgccctctttcatggctttcaggacaccgataaaagcgtctttgccaccgatagcgccgatgataagcatcaggacaccaacacaacccgctaaaccgattctgaacaggttccaggcaaacgggatagccagaagcaccaaccacgggaacggaaagcccataagtgcgtttagaaccagtaagataaaagcgattgcaagtttcatgatgtcctcctttgtttgtttagaataaagtatcacctttcgtatgggattgcaatacctacagatacaaaaaagcccctttcggggcttaatttttatgctttgttgataagataccgaagaacgtttttggcctgaacttcgttacagcagagtttgaattctgggtcgattgggaggaagccccagaggaaatcaacgctaccttcaacatccgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccaggaagcatttgccataaccccgattgctgccagtttcagagacaggaggatcaggaacacaataacgagaatctttttcatttcactatacctttgattggggccgaagccccgttaaaattgaatgtctgtgctgtttgctacttcggctaacttactgcttcggttagtttcagcttgttttaccatagcaccttgtgcttcttcaagcgttttcggcatctgacgacctttataatcagatttgaacccgatatcgctgttgtcggtatccatccagcgttgattacccttacgcacttcgagtttgaagtggttaaagtggttcttatcgccgtaacgggatttgatctgcttgaacaactgcaagccctgatcagctaactcgtcggtctcaatcacagctaacataaagtcagcagtagccggaagaccagcagattcggcaacgtcgcccatgctgatatcagaagcatcccacgcggcgcgggtagtctgcgcaccagtccacattacggtatttgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgttcccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattgttacctcttaaaccagattagcgaacatctgaaagaaattatacagctttactttcaacgccgcccataaggtcttttcaggctttgggagatttggcttgatctgcgcgtagattgcatcgtgaaccagcggaatcagtttttctttgtcttcgtccggcgtactgaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatcgcatcaaggaatggttggtgagtgaacagaggtttccagaactcgatcgagttggtttccgattcacgccatttcttttcttccagttcaagttcgcccgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaagcgagatttctcgatgttcatgatgaagtcataaccgacaacttccgtaccttctttcacctgctgtttgcccaggatgatcgcggtatctgcggaatacatcagaccagtaccaccggaaatgactttcttactgtacatttcttgtgtgtcgtatgtgtgacagatacacaccatcggaatatccagatccgccaggtaaggcgtaaccatacggaacatacctttaagtgctttagcacgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatcttcctcacaaatttatataaatggggcatttctgccccgtcaggtcttaccagtcatcaccgaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcgatgcaatcagcttgccacgggtttttatctcgcaacggcagaaccatcaccttttcaccttccatgatcggggtgattccttgaatacccttcgtatggcggttaaagaacagaacgcctttgatgtggtttggtgtccctttgattgggtatccaaaatcatcacgatattttgagatattgttagcagatgatacaccagctatttcacggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggcttctcgtaacgggttccttcggagtcccatacgttagccgcatatcgtttcttcgccgtccagaaactacccagacctttcgatcccagaggtggtccagaaatgatttcgcgatccataaacatcaggtgttcgacgttgttcatgtactcgcaaagttcacggtagcccttatcaatgataggttccatgcgttctttactgaacttatccaggaagtcaacccaatggttgttatccctgaacttactttcaccgccgactttcgcgatcacgttgtccatgcaaacataaatggagtcggtgtcacagtaacgcacgtatgcgtaatccgtggtgttgcacagttcgttaaggtattcgttaaccttacgctcaatccactgaatagccaactgcccgaacatggtgatcgcgctggcgtttcgaatatcgaagtaacgaaaatgttcgttacccaacgcaccataaagggagttgatactgattttacggttaagctgtgcggtgttcgcctgtgcgattttcttctcacacactttcttcacggctttaagcatttgcttagacagcgttttcagtacagcttttgattcatcactgaaatcttcgtagaactcgaaatcagggttgatcatttggttgtgcgcgtccgtcaggtgttcgagttcgtgcttaatcagttcgagatttcgctcacccgccatcattcgttttttccacgtcttacgctgatcaaatactttcttgatctcgaccggaatcacgcctttaacatcgcgtcggaacatccacccgttaggagagcagctaaattcgtcgctaggacgcggcgcagtcttattgatgtatttatgcatcggacgcactgcaaagctgttagcgattgtctcagggcttatattcacctgtcggatgatagacggatacagactggttaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggtgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgcagttcagacagtgaaccttcgtaatcaactttgcttttacctgtttcgaactcagcgatcgcgcccagagcgtaagttggttgcggggtgaaactgaatttcttgtagagatccattccatccatttgagcaacgccgtaaatctcatagcccagttgttcgttcccgtaatggtcggttgttgtcttcgcagtcactttcccgaacgggctgaaatgacgaacaacgttttgcccgaagatgttcaggtaacgggtgatgatatacgcgatatcgaacttgtttgagttccagcccgtaacaataacaggcgtccgctctttccagtctttgatataagccgacatcagcgacttttcggtctggaatgaacggtaaacaattttcttcaaatcttcttcgctgatctcgttttcggtatcaactttcgacgctacccattcatctaaaccaccctcgaccagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttctttgatgctttcaaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagtgaacgctgtgcagattcacgaagtttttcgtgtccctcaagcgaattcaactgatttaccagcattgtatattcattcatgatacgggtatagaaattagggaagtagttctgcgcgtaattgtacgtgcgcagatccgagagattgcaggtcagagacagatcgatttcgtcgcggtgcagacgggtaatcaagtggtcttcttttttgagagagttaaggatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttttcgatttcgaggataccgaaacagcgtttgatcatttgcttcatcagttcaacgcgttcttccttcgacggggaaccgaacttgactaccggacaacgggagatcagcgcagggtgaatcccgttgatgttgttcgcggtgatgataacagtaacgttcttgctgtacgcttcgataaagctacgcatgtgcttctgtgcttctgccatgccagggcgatcgaattcatcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacaggtcgtgagttacttcggcatcagtgcctacaacgttcagcatgttcaggaatgagttcagatcgtagatacctacatcttcgtcaattacgtcagaaattgttgcttctgcgtaaactacgctgttgatggatttcgtcataatgaacgaaccctttttcagcattacagacgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggactcgttgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccaggtcaaacggaggggtgttgtcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcaccaccaaacggacaagttacagcgatacctggttcatccagatcagggttgccagcgatagcagcggtgatcttatccatgattttcttgccgaaacggaacttaaacactttaccttcgttttccggcgctttcggatctttaacgaccagaatgttagcccagaaggattgtttacgcccaatcatacccagcagtttatcagcttcgccgcctttattggctttggctttttcgaacagatcgttgtcagagatatactgacatacaggacaaccatcataatcgccgtgggtagacggacagttttcaatgaaccactgattgttctttttgaacgagtgattcaccaggcgaacaaacgccagttcgtcatcagagcggttaggcaggaagcgaatagtcgcagaaccgtttttctgtgcatccagagtgagtttccactctttttcatctttctggaagccggaggaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgaggatcaagaatgattcataagaaatcaccccagactgtacgagtttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatattgcagagtagtataagatatatttctttgaatgtaaacctttcggctaactttgcgaaaaaatatctatcctttctcttttggaacgcttgttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattatacgcttcttcgattgccgttgcaacatctttcggaataaaatcaaagtcgcgaagttcttcgttttctctgtagcggatcgcccactcttcgggcatacccacagtcggatcgtccgcttccagccaggcttcgagttcagcagccctgatttgtggggcgcgttctccttcaaccttcgtaacaatatagtcatttcgcattttaatgcaagcgatactatcttttttatcgccctttatgatcttcatgcgcaaatcgttacgaggtgaaccatatttcggcgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtaaattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcacctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagttttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaatattgctcacggtttggcacgtcgatacaacttcaaccgttattccgaagactggaaaatggatatgatcgatgatggaatttcagcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaaccaaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggactccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccaacagttgaaagacctgttcatcatggcttctgaaaaatacggcaaataaaccccttcgggggttttgaggtttatatgaactatgttttaattggggatacccatgccggacttcgccaggataacccatggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgcgtttactctggacactatcaccacgctaacgaaggtgacaacgtgttttacatcggtacgcctctgactatgagcgctaacgacgaagacgaaacacgcggtttctatgtgttcacgggcaagcctgaattgactttcatcgctaaccctgtgtgtcaccatcgccggatcatgtatccagcacagaaagatgttgatcttgaacagttccgtaactgtgcggtacgtctgattgtcagtgaaattgatcaggggcttgcaaagttccaaacaaaaattgaagaaattgcctatgaaatcaacatcatagacaaagttcaaactgattcggatgtcgataccgactttgaaatcaaaaccgttcgtggccttatcactgagtatatcgccaacatgcagatcaccgacgatgaaaaagaggaagtgaataagctgattagcgaactatacgcggaggtgtcaagtgcatagccgttatgatgaatatttcggggcgaacccccgatattctcacctgttgcgtatgctgggaatgaaacatatcattgccacttctgacgaagcaggggaacccagcgcagtttgtttgaccatcatgaagggtgcatggcattcatcacgaacatggtcaatcttcatgcttgatacactggacgacgatacgctatcatatactattgattcatcggttgttcaattgatcactgaattatgtgaacggattttaaatgaaactaaacttcaaaaaaattaagtatcaaaatattctgtcggtcgggaataccccgatcgaactggaatttgatacggcaaagaaaaccctgatcacggggaaaaacggtggcggtaaatcgacactgatcgaggcgttaacctatgccctgtttggtaaatcattccgcgatctgaaagtcgggcagttggtgaacagcgtcaacaaaaagaaatgcctggttgaactggaaatcgaatacggcaaagactcgtacaaagtggtgcgcggacaaaagccgaaggtattcgagatctggaagaacggcgagaagttgccggaagactccgcagcaggtgattatcaggcacagcttgaatctatgctgaacatcaaccttgtgggcttcaaacaggttatcgttctgggtacagcgggttacaccccattcatggaactgaaaaccccagaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaacttcgtgatggttattcgcggctctcaatgactgtagaacagtttaaaaagctggaggtgatgtatcagaaaggcggtgagtgtccggcatgtaagcaagcgattaaacccactcctgagcgtatggcggagatcgcagagaacatcaaagcgggtacacagcgtttaaccctgatcaaaaccaaacaggacgagttacaagggatcatgaatgacttgctacaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgcaaggattaacctagcgttgcttatgacctggcgtgatgtaaccagcaaagtatcgggtgttgatttatcgcttctggtactggatgaaatatttgatggtgcaatggacaaagacggcggatttgcagttcgggcattgcttgatgatattgagggtaacgttattgtaattagtcatcaggatcttgatccgcaggacttcgaccgccacatcatcatgtctaaggctggacggttcacaaaaccaacaatcaaagatatggtaataacatgttagaacgtgaatttgatttgaaaacctctcccgaagtggagaggttttatctccataatgaactattggaagaaaaacatgtagttacaatggcagatgttgaggaagcattcaaagataaccccattgaattgacacgcatcaagaataataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaagctctttaaacgtgcttctctgcgcaatcaccccgaccgtggtggtagcactgaactcatgcagaaaatcaaccaggcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcgacatatcgtttcacctctggtgatgcgttctttgacttctctttctcttgtcaaccgccgaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaacggtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctcagcacctcatgtgaagaaagaagccgaacagaaacgcactgaaacgcaagctaaggacgagttaggcgcacagcctacgaaaccacaggcagcgaagaaagaagccccagcggttgataaggcgcatcaggcacagatggatcgtgagaagtcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttccctttttttatgaggtgagtatgattattcaggtatcggttcagggcaataccctgacagtaacaaattccattatgaccgctatggctgcatgtcgtgatcatgtgatgtcaaaccctccggtaacggaaattctggaaattgatgtatgggaagacggtgtgatcgaagaatcctttgggttcactccgttagaggaagatttacgtaaaatggaacaatggctatggcaaactgtaccccaatgaaactaccaaaacacacaaccctgttaacccgcgaaaaactgcattcggttgaatggagtccgttagatgtgatggtgttcgatctggaatccaaaatcatcaacgcgcatgttaacggtttgagtatcttttctgttgaatttgaaaagattcgcgggtacaatgaagcctgtaaagacaaattgcgtgtcatggttgaagctatgggctacatcgtgactattgaagacaacaaaatgtggatcgcgctatgagcaaagtaaaagcagttttcgccgttggtcatgatatgtacgaaatggactatgctttcggttatgaacagggtttaccgtggggacactgcaaagaggatttacagaacttcaaagcagaaaccgcagatagcgtcctgatcatgggtgcgaacacttttacttctcttcctggtaaattgccaggacgaattcactgcgttctgtctggttctggtagtttcctcaaaaccaaaaaaggcgatgttgctgattacgtcatccacggcggcgggttgtctgctgcaatcgacgtgatgaaagcaacgcatccagatcgtgatgtgtgtctcattggcggtaaggggttgcttctggaagcaatcaataatacactggttgatgaagtggttgtgacgcacatttacggacatcacactttcaatgcgccagcttttaaacgtgatgtttcattcacggttcctgaattctgtgaagcggttctgaaatatgaactgactgatttcaaaattcagcagatcgagtcaaacgaacgcgtcagaaaaattatcgtcgatcgacatacgaaaaaggcataaaatgaaacaatatcttgatatcgtcaacaccgttctaacacacggtactgcatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatcttggaccgatctacgggcatcaatggcgctcgttcggtgaggaaggttctttttatggtgttgaccagattgcaaaaatcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacaatggtatcagcgttcagttgatgtcttcttagggttgccgttcaatatcgcctcctacgctctcctgacgcatattatcgctgatatttgcgggtatgaagtgggcgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaacagtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattttcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttcaaaaatccgtggtggtgaagcagtgcatacaggcgttatcccgttctggaaacacattcagacggcggttaaatcctgttcccagggtggtgttcgtggtggtgctgcaaccctgtattatccgatctggcatcttgaagttgaaaacctgctggttctgaaaaataaccgtggcgttgaagaaaaccgtattcgtcacctggattatggcgtacagcttaacgatttgatgtataagcgcttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaactacattttcaacagtcatcacgtaaaccagcagggtagtttctctgttcctgttcgtatgtcgaacctgtgctgtgaaatcgcgatcccaacttcaccactggatgacgatgataaactggctggcgaaattggactgtgtacgcttatggcgatcgttctcgataatgccgatataagcgaattcccagcccttacacgcatcgcagtacgcgcactggataacttgcttgattaccagaactaccctgttgcagcggctctgaaagccaaacagcgtcgttctctgggtgtgggtatcaccaactatgcatcctggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccaaaataatcagattgacttctatgattatctctggacaatggcaaaacgtggaaacaaaggttatctgtcgcacgtagcggttatgcagaagtttgttgatcaggctatctctgcaaacacaaactatgatccggctaacttcccagatggtaaagtgaaatctgaaatcatccttgaagatctgctgtatgcaaactatttcggcatcaaaacgctgtactaccacaacacccgtgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcgaaagagttcgataaaattctgcgcaacgaagcgatcatgaaacgttcggcttccatgacaaaatactacgatgatctgatcgcagaatgtcatgaactgaaaaacattgtgctcaaaatcgaaatgttaacgtcccacggatacccagacgaatcgatcgcagagtacgaaaagaaacgcaaagagcaaatgcgtaaatgcaaggttgctctgtatctgtgtatgcacgctgtcaatgctctggaagcgatccgcttctacgtgtcgtttaccttcacgttcaactttgccgaacaaggcaagatggaaggtaacgcgaagatcatgcgtctgattgcccgtgatgaagcacttcaccagaaaggcactcaaagcaagatccgactctggcagatgggtaaagatgacccagaaatggcggaaatcgcttaccagtacgaagaagaagcgacaaagattttcctggaagtgtacgaacaggaaaaagaatgggctgaacacctgttctctatcggtgatgtagacggcgtatccctgaaaagtacgattgcctatatcgaacacctgacagatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagttgggatgtcgatattcagagaggtacgaaattcggtaatcccttctacaagggaacacgggctgaaaacatcatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaagaggatagaccggagtttcgttaaatgtggcgaattccggcattgtgtgtattttattgaaatcgacggtcggatagtgtatgttggaaaatgtcgtgatttgtggaagcggttagacacataccgcaattcgaaatactggcgggaagcaaaccccagtaatattttgaaaaccgcacgtctggaaatggcaatcaaaaaaagtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctattcaaccagctaatgacgctgtgtaacgaaagcgaatgcttctacttcattgatcaaaaaactgtgatgcaaaccggtgttcgcatctttaactatcgcatggcgagctattccgactggttaaaacctggtgcgctggaatgtcgcggtatcatgtttgcgatggatggggaaacccccgtaaaactcgtcagtcgccctatggagaagtttttcaactatgccgaggtaaaggcatgggaagcactgaaagcctctcctgtgacgattggtgaaaccgtagtggatgtgatgattaaggaagatggttccctgatctctaccttctgcgattccggctatctgggtgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaaatcaccgatctggatgcgttcattaccgaagcctacacgaaagaaggtttcgagggttacgtgatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctgaatcgtctgactgcaaaagcatttcaggcaatcgaagacacgaaaggcaaatcacgcaaagactacgcgatcgccctgagcgctgacttaacccctgacggtcgtattatcttcgggcctatgatgcgttatttcgatgataccgataagcaaaagctggtcgataacatcgttgcattaatggcgaagaactacgaacagtttataccggaagaatataaatgacattaccagcctttccaaagttaacttctttggtgtggcctgtcattgtagccctgtctttggcagggcttttgtacatgacaatcacgctaaagagtgaaaatgatcaattggctaaagatatcaaagagttgcaggctgatatcaaaaaagtcaaagagacaaacaacaccaatacggtgatctatgtcgaacagaaagcgaaggatcagcagttggtcaaggatgccggacgtaaagacctgctgttcaagaaaccaggactgatcgaaatcaagatcaataagtccttcgaagagtatatggcggagtacgacaaatgaaaattgcaacgttagcccttgttctgggcgttctgttggttgggtgtgcggagaagcccccagaaaagattttgcctacactccccgctaaggtgaatccggtgaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacggataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcacgtcaactgggaaacactttgactgtttcccgcgacgatatccgcaaaaccctttattgtgctggcggtgatctcactggctaccgcttcaccgaagagaaagaactgtttgtttgccgagtgcaagaagatacagttcgtaatgcactggcaagcgggaagaatgttatcgttcacaacacccatttgcaccaaaaagatcatgatggttggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccaagcaaaccgaaatgtgttatcttcgacgttgacgggacattaaccaaagtcggacaacgtagcccgtatgactttacgaaggtgatcaacgatccgcctaaccctcctgttcaagaactgttcaggatgtataaggccgctggctatgcctgtgttgttgtgtctgggcgtgagggtactgtacagtgcgcacatgataccgctgcaagcctgattgggtatggtgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtaatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggagtattatgagcgacaaaatcagaaagattcatcaggcatggttatgtactgaaccaacgatgcttcgttatggttgtgtgtttgggttggttgataacgatcctcaacaggacattgcaacaagtccggttgttgaatacgcgattccggcgaacaaatcgtttgttgaagtagtgacacgttcaggtactacgtatcacatcgttaaccctgataacgatttcatcaaagacattctgaaatatatggatgaccgatgaaactacttcacatgatccgtgctattcaacacagccaggcttctcgatgcatatcgacccgtgttggtgcggttatagtaatgaacgggcgtgtggtttcgcagggttcgaataatacggttgattctgattgccgttgtgctgatcataacgagcatatgctgaatgacgaaggtaaactgaaatcggttcaccgtcctgagcattcagcatggtcaaacgataacgagatccacgctgaaatgaaagcgttgctaagtgcgcatactaatggtatcatgcttaacaacgcagaattgtacacaaccgcttcgccgtgtccaaactgcgcaaaacatatcgaatggtatgctgcaataggcgctatcaaagcggtgtattacctcgataaatacgatcgtggtaatgatgaatggatttcacgcttacagaaatatggctgtatcgtggaacaaattaaacgggaagagttagaacctcatgttaacttttccagattagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgaaaaagaagcaaaagagaaggaaacaaaatacgtttccgcacattacaaagcaatccaggcaatctacgagatctaaaaatggctaaatctattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgtccagttcgaagacgtatgtaagtacgcgaaagatgttgatccgctggttcgcgaaatctatcgcaaacagttctaaaaattccggccctttagcttaattggttagagcgggtgactcataatcgcgcggttgttggttcgaatccagcaggggccaccaaatacgcaggtgtagttcaattggtagaatatctggtttccatccagattgttgagggttcgagtcccttcacctgctccaattcgggtgcgtagcgcaatgccgttaaatggttcggaatatgcaaccttatcgtatgcgataggctctgttggtatccggtaataggttccccggaatgcggggtgaagtaaagaaacttccagcccacaaatttaaaagagaaaaatatgaaaggtctccaaaagctgtttgagttaaccccaaaaattcgcgaaatcactacttctggcgatgaaatcaataatgcattgatgaagtttttcaccgaagaaattgatgattttgaaactctgttccgtcacgcgttagaagcgtattccgtgaacgggttctttgcatcaccacaggtgaacagcaagaaacaatgccatcgtcgattcttcgactggtcgatcgtaaacgtggttcgccgtactgacatcgaaccaacaaatcaccagttgatatctgttgattctgctgtgtttatcatccagtatcttatcagcggcggtttcaaatcgaacgatattccgttcacaaatgaagctcttatggaagagtttgcagaagcccataagtacatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtgttggtatccaaaaccctcgaaatggattcagtgatcggtaaagctcgcgttgctccattcgcaaaacgtgaagtcgatattgaatttcaacccactgttaaagtggaaggtggacaacatttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttcgtttttatgcaaaataatgcttgcactgaatccgactttcttgtatctttaaccacgtaggcaagacaacttaactttgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgctcgttgggctgctgttgtagttatcgctgctcctgtgactcctgttaaaactctgtttctgggtgcgcgtaaagccgaaactctgaaaaccagcacttgcaataacagaggtgttcataatgtcaccgtcatcaaaaaacgtagctttggtttgagggcttaacatgagtaccaaagaattagaacagaaagtaatggggttcatgagtaacagcgaagatcgctatgcaaaacacctcattgtcgaactgatcaccgcgttacgtcgccgcgacaaagagatcgaagaactcaaaaacgcatcggttcaggttgtctataaagatcgcgagcgtagtagctgggaaaaagaatgggatgcaaacccccaagaccgccaccttttcgggaaataagcatgagttccattaacatagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtattgaagtaagaacgtttcagttcgaaatgcgtcgtatcccagaagcatcaatgaatctcattcgagaacacaacgcgaaaatcgtagaaattgatgcatacgcgggtactgatctttataatgatgcgaaggttgacagcattgatttagaccttgagggtgatatcggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcattaaaccgctatcagtgtgtcgtgaattcgggggatactccttcgcgatgtacacaaattctgaagacgacgcaaccgcgtatctgaaaagtatcggtgcaatattcgacaaattcgaaaaagtatggaaggtaggtttctaatgaaaaagtattttattgaagcggcagatcgtatcgttcttgctctgttgaactggaaccgtcgccagaatgtctctatcatggcatcaaccaacgggacaacatatgaccgttatgatccggcgcgtggactccataagccttacgaggttaaagcgtgaagtattacggattcaaaacgagtcattacggtaaagcataccgcactgacaacatcgatcgcaaacgtccgtactatgattctctggtacgtgctggacgcaaacgcgctcgccaggaagggaagaaggaagctgaaaatgaaacagaatagtgaactggctttgattgcttttggttttgctctgggttgtatggtttctgcattactcgttaacttcgcggggtgattatgggttattacatccgatttcctcatggttatatatccagtagtgtttttgaaatgatcgaaacacacaaacagaaaatcaaaaatgtttccgtttctaccgatgacggtggcggatttgattacatcagtgctcactttgaaagcgaaagcaagggacttactgattatttccttcgtaagctgggtgctaagttgatcgacaaaaataataaagtgtatgaggttattcgataatggatatcggatcaggtagtcagtatccatcatgcgcattgagcaacttcgctccacatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatccgaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtgctcactgaacgtgagtttgtccgaaatttaacccgattgagagatctgttatgatagccttgattatcgtcggtatcattctatacctcgttgttggtgtatactgcgccgcacgtttttcctggtgctttggtgtaagccataacggatatcacacaccaaaaactttgcttttaaaacataccattttcccgctgattgtgttattctggcctttcttcggtatatggttcatattcgcaatatttttcgactgagagttattatgaaagattatgatgaaagagtagaatgcgcgttcctgttcaaaggcgcgattaacccgctggcattactccacgcgcagggcgctttgagttctaccctgattatgggtgttatctacaaagcgggtgtgtattacgttaccatcggcgcaaacaacattaacgtgatcaacagctatgttgaaaaatgtaagctgagagatatcgttttcgataaagtcgaactggatgttcctggcttcgacgctgtttatatgtacaaggataaatgatgaaatactcagtatattttgaatctgcgtatattcacagtgacgtattcgaatgggcgcgtgatctgaatcagaatattgttgaggttgagacatatcaacaccgcaggggtgattttttatgcgcgaccttcgaatctcaccgcgaattcgagaaagaccgttttcttgaagtaatcgaagcaaacaaacgtttattcttttttgattcttatgaggttaaatcttgaaaccagttattcttaccgacattgacgggatcgccgtaaaatggcaaagcggcctcccgttctttttgtctaaacacaacatgccgaccgatatcgcgctggatatggttacagatgaaaaattccgtgatatgaccgaaatcttcgggtgcgatcaccaactggcgaaaattctcatggaagaatacaataacagttcgtttattcgctatctaagcgcgtatgacgatgcgttaattgttatcaaccgtctgaaagccaaatatgatttcgtggctgtcacggcgctgggaaccactcctacagcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgccataacgtcatcagtcagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctgaaagagattttccgcattacgtacacgaaacagattatgtttcacattaagaagttcccgcaggtggacggtaagccaggcacaaccccgctatcgaatgctatcgcggatttgatgtctgatttggcaacgcgaaaatatacgggcaacgcagcccgtgatcgtttgctggatatcgtatcatcagtgaacgagaatgatcgcgaagttcttcgccgtatcattaaccgcgatctggaatgtggtgcgggtacaacgttaccgaaccgcgtatggaagaaactcattccagaacagcctcagtgcctcgctacgccgtttagcgagaaagccttaaaacgtattcgcttccctgcttactcgcagcttaaagccgatggtgcgcgttgtatgtccgatctgttagagaaccagatccgcaaagcaacccgcgcggggaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaacaccgatcgaactgcgaatcattgacgtgtacgaacacaccaaagaacctcataaggttggcgggttcgtggttgaggacttatcaggagaagccagaacaaacacaggttccggtctgactgatacggattaccgatacgatgaagacggtattaaccgcgtgtacatcccgttagaagaacgtggtgaactggatcgcgaatacattatggcgaacaaagatgactatatcggcgctatcgtcgaaatggaagttgacggactccagaaatcgaaaacgcgtaagaagggcgaacctgagttcagtttcttcctgccaatcatcaagaagattcgacgcgataagaccgaaccggatgacattcacgttatcttcgctgatctgttttaaatagcactttttgctaaagaagccccttgcatatgtgaggggctttttgtatattacacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgcgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgtgttctgggtaatgtaatggtacattacctacatcgaaacgaaaggagaaacatcatgaaagttatgcacactgcaaatcaacttcaaaacggcaactacgctatccacgatgctatcggtgcgctggttggggtttatcttcctggtatcaaactccttgaagtaagtgggaataccttttatggtgttgaaaacatcgaagcagcgatggaaattatcggtgacctgaaatgagtaagaaactcgaaatattcgaaactatcagcgaagacccgaatcttcgctggtgctgtgcgaaaactgggtttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttgaagcacgggttgcggaagcgctgaaagatattgatttcggtcgcttccttgataacgctccaacgataccggatacaatatgccttaattgtgggcgttgtgttatggttggaaaatgctgtgataacccgaatattgttatcatggacaggaaagaagtttcaccggaagtgtgggatcagattcaagagatcatcaaaaacccacctgaaccgacgaaacgtttacgcgaacttatgagcaggaaaaccacgttatgaaaaatgaaccaagtaagactgtgcgccttatccgttgggaaggacaagaaatccgttatgaagatcaggatcgtgaattcgtccatgaaatgcttgcgcataatctgggattcaaaaacgccgcactggtgatgatgcagcaaaccagtgatgaagacacctggcaatgcgtcattctcgatctggacaaaaacaaggattacaccgaagatgaactgtttgcgctcacagagaacgctacagcgcgtcagaagtgcttcatgattgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaacttaatccttttctcatagctggataacagttgacacttcactgcctggaacggttgcccctgtttgtctgggttctggaagttgttctcatataccgcgttccggttcatggtgatccatgcgttttcaatatcggtactcgccaggatatcactatacagctttttatccgtcattgagaaactaaagaaacttgcatccactaacagggtagtgttatccttatgcgtaatgtattccgctttagtgaataccaaagtgtcacctaaaaacgggttactaacgttgaacttgtaagcctttatcggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtctggttatactggaacgacacctggataatcggtttctctgtcaactgataaattaactggttatcgtagatctgcatcaacgtttcagaagtaccgttgatgatggtcttctcgctcattgagacaagggcaggtaacaattcaagatagacgttatcagcgaacttttcatatgttggatataatttaaccgacacgatgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcataatgacgataaagcaatggctgtattgaaagagatcggtattaatctggatgatatgaaaatcagcgaagctaagtatgaacatacttttgataaccttcgattggtcttcaacaaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataacacccttgaaaccgcgctgaatacactggacatcaaagacagtgtgaaatcctttgaggaacgtttcaaagagaaattcgctggcttccaggaacaatacgaacaggatcagcaaccacttgctgaacagttgccagattttgttggaccatcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaataagaagatccgcgataaggataaagaagagaagaaattcagcaagaaaatattgtctttgctgggtgcaatcaaggataatacatccggtcttctggctcgctttatcggttattctctcgaagcgctggcgaagtttgcaaaatggactctgattatcggtagtatcgtgtttgctattgaagttttaggtaaagtcatcgcttcatggtttaatgatttgcttaatgatggagaagcatccaaacaactttttggatcatatttcaacaatataaaggcgttggcaaaaagtatagatgacggattagataaattaggtgataaagatgcaacattagcagaaaaattaaaagctctgttagtagaaccatttaagattctgggtaataccattaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgacctgattctgctgaaacagcaggagatccaggatcagaatgataaagtggttgaggcacgttctaaggttgtcgaacaggttaaggctactcaaggtacattctcatatggtttcgggcaacagacggacgcacagaaagcgctatctaagcaattggaacagatgcgcgatcgtgtggctattgaagaaaagatcaccgaagagaagaagaaagaactgaaagcattgcaggaaaaccccaaactgttacaggctgaggttgataaagagaatgccgctaaccgtaagcgcgtggacgaaaccaaacagatcgaagccgcgcaagagaaagcgaaacctaaagcggataatgaattcgatcagggcgatgaaatcctgaacaaagacaatctgacgggcaacgataaaaaggtaatggaaaaactcatagaatcgcttgaagagaaaaataattcgaacaagctgaatgaggacgacaaagaccgctatcgtgatatgatctcccgctggcaggaaaagatcaccgcagtaccggaaacgagtgcaagtattgacaagcaaccggaagcagtgaaagcccctgttcagcctacaacgcctaacagtgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgcagaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcactgcatatgaattcactggtggatttgcaccaggcagtaaagataactaccgttcactacgtcaagcagcacagaacgcacaacagatcctaagcgcgaatacaggaaacgttcgatataaacaagttttgaataaccgtactattggtacgctcaaccctatttgtcaaatacttttaccgcgaagcctgaacgataacgaggttaacagccaccgttaccaagatgcaaccgatagtattgttgctaaaggcttatcccgtgcggtatcaaacgttatctggggcgctattgagtctgctagtggtggtattttggcagaccgtagagaagcagttgatgttggtacgaaagcagcgtttcaaggctctgataagcgcacaaagatgtattacaatactttcgttatagaaagtcgttatgatctgctagaacttatcaaaatctattatctattcacggtgctgggttatggtacgacatcaggaggaactgccgccgaaatagcagaattagctaaacaaacaattaatacatcatcaacagccggggcaaaacttattaataatgcagttgcgggaaatggtcctacacctactgtgtctaatggttcgattataagcgatcagatggttgattttgtaactaacattgaagttattaaatcacctcctgtatggtttatacgtgatttccagacgggcgacagtttacggttccctcattctacatttgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaatagatggtagtatgagttccattaacgcgaataacccgaacgagttcatgaacgctattacagggggcgtaagcaagctattcagctatacggttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacattttcactaaggtgtattgtgtatcgttcggtaagaacgcaataaagatccgaatcaaaggaagcagcggacaatcagaagcattcatgcatgtaactgattacgttttgcagaatgaatatgcccttgatgactcgcttactctgggattcaaattcccgaaacatcgtaacaacagtgaacaattattccttgaatgtgtccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcactgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtagccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatagtgtcgtaacgcacttcttcgacttcgaagcagaagttggaatattcaatcattccgatcttgtttgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcattcagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattgtcgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcagatcatcaatcaattcgatgttggctccgtcgaattgtttggtttgttccagcatactcgtaatctttccgtatgtagtgcgtctggtttgttccgtgtaattccctacttcataacggtcgatccggtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggcaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgattaaatgcatcatccatgctttcggtagctgtaagcatttcagattcacccgctacagcagccatttccccagcttcatcactgaattcgctttccaattcttcccagtatactatcgttatcatggattaccccaaacagattttacatttacagagaggacattccgcctctttaacgcgcaagcgctttgttgctgttcgcttcgctgtgttgtgatcatacacatgcaaacagcgataacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcctcgtcgtattccggttcgtcgccgcactcattgaagtgaacgattttaacatcatccagattcagttctttcagcttgtcccagatgcgggttatttcgacgctattacatccgaacgcttccagtgtgattgtaccgtcatcatgtacttgaggaacaccccagcgcggacgatgatgaatttcggtgatcatatccatcagcgattcaacgtttgactcaccgtaaatctttgcaacttcctgttctttaccagggcggacaagtcctatcccgataatgaaactactgcttgagctattgctcacgaacccagaacggatcttcatcgccttgcctcgtatttcgcgttatctgcgattttctcatgatacaggttgtatgacaacaccagcgggatacaagctactataagcccgatgatagccagttgatattcgcgtttatcgaacgccatgaatgtaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctggcgatcgtactttccaaacaagcggtagagttctgcgctgtttcctggcttctcaatgctgaaattatgcatcccagacagaataccatccagatacagaacagttttgttatcactgcgcaggtgtccaccgaccttgtagtagttgctgaacacatacggcttttcgcggatatcttcgatatcgaaatcaccatgatcttcgatattgccaacatgggcgaagaaatgatgatcttcaagttcgagaaggattgcaccctttttgtatgggaatccgactaaatcgatctgccagccattttcaccgacaaagacatcatcgacaaccacgaaatctggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcttcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagtggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtaaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgtgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcggattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaactgtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattcagcaacgtcaaacgcaagcgcatacattaccggattccatacccgaacgatttggagagtatactcgttcagttcaaatcgttcaagatattttcgcaaagaaaatacatcaaacggtgcgggacgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcatagataaacacgccgtcctgattaccgaacttcgtgttgtactcttcgtacaaccacattttgatcagagcgtctttctcttctgtgtccagatcgtaccagtctcgcccgtcatacgcaagcgcgatttgagggtttgaacggtagcgggtttctgcgctttcttcggtttcccagtcatagcgcttatcgtcgtagaacgattcaaagctattacccagatgaccacctaagtcacgatgaacgtgattgaccacttcttccgctgtcaacggcggatcgtagtaaccacaatcagggacgcaatcgcccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccttttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaagcggaaacattcacgcggggttaatcgtctggggttcttcccgtcctgcaataccagacattgaacaccgtctttgtaatactgcgctgttatcgtcccagtgtgcgcagaatcgcttgtgacggcctgataaccgaaacccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttgtggtagtccgaaatcctttgtgttcaggcgttgatagaatacgttgtatccttcggcctccagaagcccgtaaatcgttctgaacgtcttccccttgtcatgggttagcagttcaggcacgttctcaaagaacaacacacggggctttttagcgcgtataatgcggaggatttcaaagaacaccgtaccgcgtacatcatcgaagcccagtttcaatccggctttactgaacgcctgacacgggaaccccgccagcaggatatcatgatccggcactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcgtcaatgtccgcccatagggttacattaacgtgtttgctatcttcgtacaactggcgaccatcaatcccgcccgtgtaattgctttcggtgcgttcagtaacttccagtcggaggctatcgcgcataatctgaacaacagcctgttccagtgtaactgcgtctgggtttttggtatcgcccagtacaacatctttaacgttcaaaataacatcagtcattagtaccactccgttttaataccgtgtcggtatgcgtcaatccccagtggggtaatcagcaaccatgctttcgaattatcgtgataacccgttactcttcgagcgtaacctttttgaatcagggaatcacgccctgatttgctgggtacgtcattgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcgatcaacttctttcggatatgttgaaatcgctgcaaggcgttcgacttcacccatgacttcttccagcttttcctgtacggttgcgaacggtacaccgccagctttaaccagtttcaggaatgcgctatcaggcagaggataaacgatatcaccatctttgtaaatctggatcaactgcataccaccacgcaacgcgtgacttaacgctttccagtcgatcccgttgttggcttctgcttgtcgtgcgcgttctccgtattcatcccagagtttatacactgacttgcgcatttcatcggctttgatcgtgaactggaatttacgccccagcacttcatagaagtcctgacaaccagatttcattgttgtgtcggtaacgaatcgacagaactcgtttgtagggaaacgatccttgatgtcagacactttcacttcacgcgtatagcgtttcatatctggtgtgaattcctgaataccaccgatcgtttcggtttctttcagtacatcgacaacttcgcgcagtgcagccagtcgagaacccttcacaccatatttcgcggcttgcttacgaacataaccgaacaggccagttagttcagtggtgtaaaaacgccagcggttagcgcggatatactgccagatttgagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaatagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaaccacttcgatcgtaagggattgcccttcggacggccttacaatgtccagttccaggatctcacgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgcgctcttacgggagtacatgcgacaaaccagagaaccatcttgtgcgatgtattcaacatggtattcacggcgttctgacgtgaagatgtctccaacaacaaccggacgatcgacgggttggcgtttagtcccttcataggacagtttgccgttgccgtctacggcgcattcaatgcccttatgtgtgacgctcgcaacagtaacaggctctacagttccaccgatcagcattgcaggatctttggttcccagtttcatcaccagtgtttgacggatattatttgacatcggttctgtaacaaacacataaaccatatcgtttttatcacgcgcaacagattgcaaagtaaaattcttcgtacctactgaacccgtgtgtttgattcctacacgattaccgggttccagcgacatacgacattttacatcagatataccgctaagggttgctactttcatgatttaattccttcaaagtcttcattagatttccagtacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgagacagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttcatcttttatcagagtcccgtaaacgctacgataatctgatagtggtcatcgaagaactcaccacgattttgtttgacttcgtgcataggcatccagaacgcgtctaacgcatcgtcagaaccgcccataatacggggcagacttccatcattgttaggttctaacttgatgtactgcgccacagtcggttttgagaagtatacggaacgtttcggatgatcgaacagcatcgaattacggattgaaccacggataaccttttcaggaaccttgatccgcacctcttcgagcagttcgcggattgcacaatccaggaacgtttcatttgcgtttttgtgtccaccaggaagggctaacgcgtctttacctggtgcgaacttacgacgaattaccagcaggtgattattacacacaaccacactatcacccgtgcagcagttcagcgcgtcggggtatgggtagtttttgaatttctccaattcgctttcccatttctcgtattcgtagaataaacgccagaacgtgtcttccatcatccatttgtcgatataatcgacggttgtttgaggaacaaagcgtaacagtttcttatcccatccgtttttgtggttgaagataatcggacgcagatcggttgctgatagatccttgccgtcaacctgaacaggatcaacaggtacgtgtgtccatccaaacgctttaagccagtatgaacccgcatctttttcgtaaccatagatagcgattttgtcgcctttggtttctctgatcgcggtacgaacagaagttttccatttctcttcgttgtaaagataatctgggatgtgctcaaactgaacacggataacatctgcgatcgggaagttagcgtttaaccatgagaagatcattgtttgacgctcacgcgctgtcagagggtttaaaacgttagggtaagcatatgctgaacccagaaggatgtaaacggtttttgcttcttcgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagcgggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaactgcctgttgagcgatttgctctttacgtgccagttctgctttttctgcgttcacctgttcttcacgaatttttgtgttttcaacctgtttcttaatcgcttccggcaggtcgatgtcctgcaagaatacctgtttaacggtgtaaccgtaaggacgggcatactcttcaacttcctgctgaattgcgatctgtagctggctttgaacttctgcgttatacagatcctgtgctttcggtacagatttaccgaactcacggacagttgacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttactatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcgcaacctgatttgtgtttccagttggttgagtaccaacgaataccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaataagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccagcaaccagtaagaaccctcgaacagattcaactggaaatcagtacgcagaccgtaagccattacagggatttcgagttcatcaacaacgcgacatagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatgttgattttgcttttcagttcgcccatttctttatccagtccttcatcaacaagacaaagaatgtcaaccgccgttttacgctgtgtgatgtttattttgttcgctttcatggactgcgccagcgcttcacaggttttcaccagtgcggcgcgttgtcctttgattgcagcgatccgcttgttcgctttcttgatcgcccgacctgctttgataggatcaatcatgataaatccgccttacgtggatcaatcgatggatcgaagtgaacgacaatgatcgggtaatctcccgtacactcgtcaataatagcgctaatacgcagccaatcgcccccagcaagccccgcaccgataagaggggtaatgataggcaatttttcaggaaacgcactggcgcgttctacggcgctcacaaagcatgaccggattgcatcataatccacttgtgggccagtaccccagaatttaaactgagtgtaggcattgaagacaatctgaccttcttccgtcatgtagatggagttagtgcctaacttccgctgatcgcctttcatagtcaatgcatcaattttgaacgcaccagggattttgtgcttcacttctttagcaatacccgcgcccatgttgcagtaacagttacacccgtggatcaggtgtacttttcgtttcaggaacaactctacagcgttccctttgatttctttaataatcattttcatcgcctgtataatggcggtaagccagcacagccagccccgcgatcacaaccacaacacacattaagatataacctgtgttcatttaaattcgtcgtcccatctttgccacgcttccaactcgtcatcatatacagggaacgagctttcgtttggctgtttaacgtaataccagataatgattgcagcagcaatcacacacccataaaagatcactaatcccatcatcagtataatcctataccagcgttatattcttcaaccaggtaagtacggagtttttcacaacgttccttatttggcgcattggtgcaaaggttcatcattggttcagactgcaagaactcacgctgtttaaccagcttttgacgtttgtaaaggtgtgcgttttcttcaccccacacataagccgcgtccaattgttcagcgattacctgttcacataccgcaacgtctttgatgtcgcgatggttacagagttcagccagtcggtcatcggcatgagcaaagccagcaaacagagcgaggaacagcgcaagttttttcatcgttttaccttagtatgaatcgtcttcgatagggatataataatgggtttcgcagatatacgcaagcactgatcgcaaactatcgctttcaaattccggcttttgattgcgtttcagactccagcccgtgaaacacatccagcgttcttctgcaacgtcaaaggctaaccagtacgtgttgaactgtgaacatgtatgttcgaagatatcgaacagcaatttaccaccaatcggcttcacatatggtttcacacgttgaagcgatttcaggactgtttcgaggttactgcgatcttcgttcatcgcgatacgaagaatatgttgatttgtttctgggttgtatccgtcgatagccagccccatatcctggaagaacttagtcgcatcacggaaaatttcatgtccagtattcggggaattgatgtaaaactccatacgttgttttggagtcatcgcacggacacgggaagcggttttgtgatcaatctcttctttgatctcttttttggcatccagcagtttactcagcttttcctgatacggcttcattaccgccctgatttctgcaatacgttcatcaataattgctaactgctgttctggtgtcagtttagtttccattacgcccccacgcgcacaaagcgatcttcaattgcatcattaacacattcgtaaatgctaacgtcattcgggacgtgcttacgaatacccactttcacgatatccatgatctctttgttgctaccccatacgttcaggttgaagtaaacaccgccgctatgaattgtgttgttgccaacatcaagatacgtatcttgactttcacagataaacagtttgcgtttttcttcaccatatgcgaagtaaatgctgaaagattccatgcgatgacgatcgaccgtgatggtgtctactttaacctttggatctttgttcagttcgtccagcacaccctgaatgatgtgcagcatgttcggcttgatgatagtcgggtgactggtaataactcgatgtgatgtgctcataatttaatcctcaattgtcggtacacacataataaaaaagcccctgcgaaattgcaagggctttttatcagataatgcgtttttcttctaacagcttcgcggtatggttaaccatgcgagcataatcacgggcttctttctttccatacttgaaccccgcgttgtaactagccagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcgtccaattccttaacataactgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaaccattttaaatggttttcgcatcgctcagtttgttctcgatgaattcagcaagattatagttcgaaattgatacgttcggatcgtatagtgcaacgatttcatcgaaagataccataatagcccgtttaaagtagacgctccagctagtagtaaagatttcgctgttgtcgaacccgcaatcagggctgaacatagcgcggtatgtgtacccgctgtatttggttaagcgattagtgctgtgcgcgttgctggtgatcaggaatttcccctggtgagtctcaaccacgaagaaataacccagacgttctttgttgtccagcatcgtttcgaatttgcggttgttatcttcgcgatcaacacgttcttcgatcatcttccagacctgttcgtattcaggccagtcatgttcgacgacaaccccttttatgggttctttgccttgctctttacgatagcgatcaattttattcactaccgcagagagaagcagtttgtcgctatcacttaacgcggcatcaatatcagcatatttaaatactgcataacgttcttcgcgtttcatactactacatccttatcacagactggacaccggatcacacgatacacatcacgaccgccagtgtaatcagtagataccttttctttgacatcctgcgcagtgtatgacagaacagcaccacaacgacaggcagtttgttttggggtaatgcttacaacttgaaccataataacctcacaaaaatagtttcacttcgctaccgcatttcgggcagacgatatgttttttcacgatgtaatcagcagcacggaagaaaccgttgtagaacacttcgtttttcttctgtacatcagacagttcatactctaacccacttttgcaattagcgcaaacggtaattagctttggactgataataacgttgatcatgtatacctcacgaaaaaaggggggccgaagcccccttgatcaaaaattgtcttcaacaaaagctgcaagtcgcccacgatatacggtatccagaatcacatgacttgaatgaccgtactctttaagtttttcaaccgcatacacaaagccgttgttaacagcagtgtttcgcgggttgtcaatctgtttaatgttcccgcatagtatcagaagggtgttctcaccgcaacgggaaataatggatttgatttcgtgattgctcaagttttgacattcatcaacaatcagaaccgaacctttacccggatcaggatgcccgattgagcgcccacggaagtaatacaggctagggaactgcaccacacctttttccagaagtccttcaacgtacttgtcaacttccggttgatccttaaacagaatgttcaggctcgtgatacaaggctcaacagacggtcggagtttttcgcccagagtgccaggcaagaaaccgatttcaccagacagcggactatcagccttgacatacatcagatttgcgaagtgtcccgcgtttaccatgtgcatcgcaccagcaaccgccagcattgttttaccggaaccagccgcacccatgatggtcacaacgtcattgttcttatccaggatcgcatcaacgaatgacgcttgcagagcatcgcggggctgaattgttttcatcagcttacgctttaacgcttgttcgtgcttaataggcaatacttcaagctgaaactctccagcagcaaccacacgccccacaatctcaccatccgatagaatgtattggttagggtagaaatctgcgtcaggaagcgatgaatacgttataacggcaacaggcccgacatactccaggacttcgacagtttcccagaacagcggcaggtcgatataacctgaatacaacacatcactatctttcagcgagtcatcgccagtgtattgaagaaccggacaacctttagacatcgcaatcaacagcatgttaatatcgcgagtcaccagcgttgcgccctgttgaatacaggttgcaatgatccgcgcatcctgtttatccagagggaattcttcggtgccgtcataatcgacgatttttagtgttacgctttccggtactgctgggttcgataagtttaacgaaacccctgtttgggtaattgcttcataattttgtcccaggattgctttggacaaaagccggatcgccaatcgtgcttcatgagcggttcgctctttgcttttcaggtgatccagttcttccatcgttgcagcggtgataatgatttcgctatcaggttcgatgtaagaatagattgaatatgggttactaatcaaaacattggtgtctaatacgtattttgacatacattaaccttatgtggtttcgttaaaaaatgtaccgaaaacctctttcgctttccggtcataaacggcttttgcttcttctggagtggtataataccccaaaaattttctttttccatctatgtttatctgcgctttgtacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagggccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacggatgaagatgacttgaacgcatacacaaggtcagcgtttttgccagttcaaaccgttcgtcgatcgtcatgtcgcattcatcgaaaatcaggttgattgcctgatacttgatggtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttcgactgcttgatgatatcgaaagccgctttggttttacccgacatccggcccatatccagcgcagtttcgaagatagacacaccgccgcattcttgcccccaacgcccatcaatgattcgcgcaaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccacattaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaaggcgatcgtgtaatgcttcgatccgttcatacgcttgtttcaggatcgtcttatcttctgggttcgttgtctcgatgcagatcagttcgtccgagtcgatagcaatcacatcatccatcagtgaagcgaacacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcgccgctcaggtaagaccagaaatcgcaagcctgttcagcggtttcgaagattgccgcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcctgaatagaacggggagaagtcctccgctacacccaaacaaacggtagtatgtccgaatgggttcggtgtcgttactttactatcgggattgatcggaagttcactagccccaacactggtcgcaaacaccataccaccagttacgtaaatggtttgaatatgcccgtaagcatcgctaggccacttgaaacggtattcagtgttccataccttgacgttgtacacatcatattcatcgaacagaggatcgttgccctttgtcgcttcgtaaagcgcaccgcgccattcatacagctttgcttcgatgtcgctaacgttgatctcttcacccgcgctcaaatcatcaagcactttctcaagggtgcggattgctccgcttaattcacgatcgagtttcatgatttaatctctttaatagaatcaagttttaaccgagcatcgtaaggcccgaaagcgttgccgttatggtcgaacttatgttcttcactcttccagtatttgccggacttcatcaaaggaattcgtctacgccctgttttattagaatcaaccattcctgtatgtgtgaaaatcatacaataccctcttcttcgagcacttcccagatcaggcgatccaggtgcatcaggttccacataaccgagtcatacgaacccagcgagcgggagtaaatcactccccatgaacgatatgccttttggaatgattcagcactgttttcatcgtgcggcatatcgtcacccgaagcgatcagcagtttcagaaccatcaggctattgagtgcctttggtgtgaattcctgttcgcttaacttcatcgcgtaccgttcgatgatcgcgattgacttcggatctttaatacgcccatctgtacggcgcgttttaaacgcgctcattaattcatcgactacggcggtacacttcatatgcttcatccttttcctgtgcagacatccgattatagcggatctcttcgcgctgttcaacttctctcacggcttcggctttcttttcagcggtcagtatgtgatgtactacagcgtttcggattccccagagatattcaatcatctgcatatcttcaacggtgtgataacctttcgtatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtctcttcccttcaacaacgatagttgcatcatcttcgatccaggttacgtgatccagattcaccggatagtttcttacggtaacagtttcaccaaccaaaggcgacacgtccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgttgacttctttaaggcgcggatcattcttcacggcatcaaccacgttaaacgcatcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacatcttttgatacatcagcaatggtaaggttcggcacaatgcctttagaacgcgcataggccatcatatcgaacatatcagggtttgtttgcccctgtgcatcagcaccgagtgcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtaggttttgatgtacttcccgttaaggatgcgaagctgttggaaaaccttgttgcacaaagcacgtttcgctttgtattccggcgtattacggattgattcgatcgtcatccccatttcgtttttagggtatgcgctcaactccgcgccgatctctctgtaccagttgcttaactgatcacgctgtgctttgtactcttcaaaagttaacattataactgatctccgtaatctttcgctgcatcttcgggggttgcgtccagtcgataaagctcaacggctaatggactgggtttgatttcgcggttcaggatctcgctgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtctgcattgacttcttcaacaacgatttcataaccccatgccccactgtactcacatttcacgttccggtacttgatgtaaactgctacaacatcttcttttttgtagttccggcttttgtagatgatttccatgatttcctccttcgtttcgatgtgtgtaatataacaaaagcccctggcggttgcaaggggctttttaaacaaaaagtgttattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgtggatctacagtttcgagatattttccgagaccctcttcccagcttttaatctgtgtcgggctgtcgccatacggaacaccatatgagaacgctcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttgcttgaatgcttaaccttgccagggaacttacggaacatctgggtaaggagtttagccgtttcaatgttgatcgcgcgttcctgatccttttgcgcctggctatcatgacggcgattcagatactgttccatttttgggttgagattcacatgttgcataatatattcctcaaaggtttaaagcgttcttttccggttccgttacatgaactgcatttcggagatcggtcgctatcatatcgccctgatccattacatgcaacacatttccgtaatttccagccatacacgaaccgcatgtaataatcggttcgtgcggccttgcgttcgtggaagttcatactttgttgtaaacctgaaccagccacatttcgatgttaggcgcgtaagtaacgtttaccatcggcatagtgcggtatttgtaagcggctttgtatgcttccagttcggtcgcaacacagaaagagaaaccgttgtcataacgttcggcgttagaaacttcacaaccaacaacagcagcaatgtttttgttcatgttcatgatgattttcctttctctgtttcgtttcgatgtgtgtaatataacaaagcccctgcattgctgcaagggcttttttgatattattcgaaatttattggcaactgatctacaattacctgagtttgatggatttcttcactcaatttatcgcggtaatgaaccagttcacgggttcttgatgcggaatagctaatgagtttatcagcggtagcggtgtaaccataaccagcacatgcgatttccagttttgcgttatcgccattcggtacgcggatatgagcatacgtcagcaagtttttaaccgcttgcaacaggtcatgatcttctttaccgatgataaactggttcggttctactgaatccgctgtttcctgatacagttcttcgtctttgttcattttgcagccttatacatttccaggacgcggttcatatgctcttgtgattgaggcacacccgcgaagttcaatttgatgaagaattccagacgatcctttttggtacattcatccagccccagggcaggtaatgacatgttttcaaaggttcgctgttcgtgtcgtggcaattcgtcccagaacaatcgggaaccgtccggcataggaagaccaatttcaccttcgtaaaatttgataatcgttgtcaggcgttgtttgccgtcgatgacttctacccagtgagtttcattaaactgactatcaaccgcgatcgcgatgacaccgcaagggaaaccagtcattaacgtagtcaggaatgcatcttgctctttctgcgtccacacataggggcgctgataggatggattcagatccagatcgttatgcttccaccagttgagatagctcccaaccatgatcgcatgatcgcgactgcgaaaagttcggagttcccgaagtcggttatgtacaatttcatcagacatgattaatcacccatcccaacaaaccagtattgatagccgcaacggtaaagcagatcaccgccaacacccgcgcgttatgcacgttggttttcagttctgcgatctcctggtccttttcactttcgaactcgtcacgggttccatagtaaccaggatcagcagcggttgcgggacgaactgcatctttttcaacgatggttgcataaccactcgttacttgcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtcctggaagatcgcgaatatttttcacggtgaatgaatcaccccatgacttatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaagtcatccatttcagtaatggttcgaccatttttaacgaaggttgaagcacaaacacatttttctgcttcggggtaattattacccacatatacgaataacacaagctcttttttactcgtataatcaatcagacccaggctcaacagttcgtgttgttcaactacaacgcccgtttcctcgaagcattcacggatagcagcattgatcggggattcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagggttgattggtactgaatgccgttcacaatgtcgttgcgtcgggcataatacagcgtaccagttttgtttatctctgccaacacttctttatcgagtttatcaggttcattgctaaatgcaatcctgaacatttcttcggcgttcggcgcgaatccgttacagaacgtgataccgagtttcggatcgaagaatatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgcctgacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagctattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttaggtgcgatgtaattaacatggatcgcgtttcgcgtgttcaggctcaacgtgtactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatcgcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcatggttcagtataacccatttatcgccgcgatgttcgatgtgctccgtgatgtcttcgactttcttatcaagatcaagcggttcagcatcttcctggatgatagtcaaatctacaggcaatgtcaacagtcttttaactccgctgatatcttcgatgcgggaatcatacgcgagggttacatgtggtttgtaatcgtcataatcgtatgttgctccagcatccattgcatctttaaagcggctatggagataatcagactccagaacgcccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttgcgtttcaaatcgtctaacgtaccattatttaggattgtataatcactcaagccaggtgtcaaaccttgctctgttgaatgattatcttcaataccagtttcacgttcaaggaacacaaagcgagtcccgaacttgctcaggtatttatattcatgcggttgacgcacatcggtaatgataaagtgatccgcgtaggatttcaacattttttgaagtgcaattgaagtccagatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgcgatctaatttttagttgatctattcaataaataggtatactatacctatactttcaaaagagattgaaaacatgaaatcattcaaagaactactttctgaatctgttcagaacaaaaaatttgctaagaccgttgatctggttgaccgtggtaacgctgcaaaaggtcagatcggtttcctgcatttcgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaaacctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggcaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcagatatgctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggtggttttggcttgtcttcttctgcgatgatctcgaactcaaaaataaaactcataattccctccgtttagggtatttattgccctttccatccgaacacacgtttcaatgtgtcctctgtgatgatcttgaactcccagcccttttgttttgctgctgcattcgcggctttccatttgtcaatgtttaccgcataagtatacagtgcatcaacaaatttctttttgttgtgaacgttgttgttcgctggcttcggtgggggcaacgtttctttcatcggcttgacttcccaaaggtaggtcacgccgttatccatttcaacatagaaatccatgaagtagcgccgtcgctttccgtctgcgttgctgaaataagggatcacaacctcttcactgttccagcgtttcacatgcgggtttctatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagacccgaacaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagtgattatatcaaggaaatggaaaaggcaaacctatgaaatacggtggaaataaatactcccctttctttgagggggtggtcgaagaagtcgatgatcctcgtctattggggcgtgttcaggtgcgtgtattcggtgagcatccggcacagaaacaaaaatctgaaactatcggtattccggttgaggaattgccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggcgagtatcctcgttatgtaggtaacgatgtcaacgtactggctcgtggtggcgcagaggggcgcggttcttcgagcgttattattcgcgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaatccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttacaatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcaatgtacaaggtggaaaactccggtggttacttgctaacttccggcccccgttgcgatcagcgaatccgacaggtatacaatcagactacaggcgcgtttaccagcattgattactactggaatggtaatcgtattgcgtacatgaaacacgacgaatcccccgcgcaccagtgcaagtatacagggatgtcagtaaacacgaacgcagatacaagcattcctccggttcctccggcgttaccatcaacgtatggggcgctaccgagtgaagccagattgttttctgctcgttctggattgggctgtattccggcgaccgtagggttcccgtatacgaatatcagcgatgctatgctttccgcgtggaacgagactcgtaaaacgttcaagctggcttttgatatgctgactggtacgattaagaacggtacgggcattgcgacgatgtttgacgggctttcgatcgggatggaagaaatcacagcgggtgctctggcattgtcacagcaagcatggcaaaccgcaatgaaagtattccgacagatcattagctctgcgtttaacatcgtgggcggggcgtgggatttgatcaagaatttcctccctactgttgcgatcatgggtgttgcgatcaacatttacgatctggtgtttggtgatagttcggttcaatccctgaaagattctttccaggctctgattgattccggcgcacaaacgtatgaaagcgtcataaacgcaatctacggggctataggcagttcttacaactatgccgttgaatacgtcaaggctggcgctcgcgaccttgtagacgcgtgtagtgcgttatttgactggtgtttgactatgttccaaaatggttgcgttgctctggtggatttgtacgggcgtatgatgcagatctggtcaatgcctcctgaaacaccaaacccgctttggtctgcggttctggctatccgaaacatcatgcggcagattaaaccgcttgatgtgattctgggcggtaacttcccagggtttacagcaatggatctgtatcagcaagcgcaagcgaaggtgaaagcgttcattgatgcatcctatgcgcagatctccgcattgtatgatcagggacaagaactattcaacaccctgaaagcacagacacaggaaagggattcgattaaacgcaagttcgatcagtacctaaactggatgtgggaacctgtaacgaaagcaacaaccgctgcttatcaggctgcacttgatgccgctaacgctgctgtgaatgcgactaaggccgcatatgagggaatcaaagcacagattgctactttgcaagatggtatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattactgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaataaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaactgttttttatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacaacgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgcttgacctctgttcaaaaagaggatatgcaaaactatctggcgaagtataaccttgcgactattacgccgtcgatccttgacccgaactatctgtacatcgtacaaagcatcaaagtaacgtatgatatcagtaagttggttgaatcagaggaatggttgcgtggtcaagtaatcaacgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaaggacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaaggacaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgcgctgaaacagacaccgatcgacaccgatccgagttctccaacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgaggaagaacgtttttatatccagcatgaatacaccaatatgtcaacgaacggcacggagatttttatttccgtagcgaactacaaatatccaggcacacttcccgatcctgaattgttgatcgagaaccctgcactggttggtgctgtaaaatatgatttgcgtcctggctatactgccagccttgcgattaactttgcgacgattcgcgctcatatcgacgacccgactgtttggaaatttggtgctcaggaatactacaacgaggcgaattatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggcgtgttgctgtataagagttcaggagaaatcatcgggttctttgaactgagttaccgcgctcgcgacaacttaacgattttctggaaaccagacaatacgttattgattgccgatctgattcagcaggaacgcgaaaaaccgtatcaaccggatctgtcacctggtttgattgccccagatttaagccatatgattacgcgctttgcgcctcaaagctatctggatcagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctactcaacgaaaggcatcgaagcaagctataaattcctgttcaaactgttgtataacgaagatgtaagtgtagaaatcgaaagttcgaacactctggaatatgatattctggttcattcaacaaatatcaaccaggatattgtaggccggacgatttacacaccaacagcgagagcaaacgtgacgtatatcgaacgccagtatgatgacggtcaattacgttggtcagtaacgctgcacaacgtgatcgggaacttccttgaagggcaggttgtcaagtctgaaaagactaacttcacgggaactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcccgtctggacggtaacggaaaccagacatttgaccttgtaactggtgaagcattgtacgacccgcacccgaaagcgggacaaccgtttgatgttccaccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgatgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacagccccgatcgtaactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaaccccaaaatcttttacattaatgacatcgtggttgtaaactccgcgccgtataaccgtactgactacggtaaaggatggatggtataccgcgttgtagacgttcctgatattggctcttgttcaatctccagtatcacgggtaaagttgaatgtgtgcgtattggtggcatttggacaccgacccacgaatcgatcgaacctccacgcggagaagcgaacggtatcgacatgggcgacggctatatctgggaatatctgtatacaattccaccagatgttgttatcaaccgctgtacaaatgaacatatcgttgttccgttccctgatgaacttgaagaagacccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaacccgctgttgaaaaaggcgcaaccatccgacccagaagtaaaagcaacgaggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggcgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacctattattcaggaaacccgattgaactgggttcactgcatgatatggatacctctacagggccaattacggttgtgcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagtgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagaacgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgccgcatggcgagcgacgtatgaagcgcataccatgcgcgtatataacacgggagacacagaacaggttagtatccctggtgaaatctgggttggtgatctaccaaacaaacgcacgttcactaatgctgaatttggtatcagtccgcgaattttgattaacccgaactcgttcgaactgctgctgaacggtcgccagcttgttaaagcaggtgatgcggatctcccgacatttgtttgtgagggcgcagaaggttatgatgaagatagctgtattgcgaactccggcgcgtgggttccttctggacaggattacagtctgatttttgttgactccgtggttacgggcattaaatttgctcaacctctggaatcccgtgatgtggtaactattcgatggttcaacaatgatatcggtactgtaatggaatgggacggtgtaggcggtattaaagaacacaccgataagatttacctgaacaacgaagaagaagtgacgctggttaatcggatcgaatataccgattataacaacccaacgcagaaaaccgctcgtaaagtagcggatacatttagcggtcgtctgttggatctgcaagcgttctttgatgttattcatccaatcgggacagtctacgaaaacgcgcacaacgattcaaacccaggcgattatatgggctttggtatctggtcacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcagcagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggtttgcctaatgccgcgcctggtgtgcgcggtattgctgctattgcgacacaggcaatgattgatgcgggtactgatacccagacgatcgtaactcctgctttgctggaataccgtctgcaaaacccccatgcatcacaaaccgtatggggttacacccgttacgcaactgatgcagaatcagtaacagtaacaaacgatctggtttctcttactccgcgctcgttgaactatgtgtttaacacccgccatgcaaaagaaaacgtttggggttctgtgaaactgtcaacaactgctcaggcaacatccggtactgatgacactaccgcaatgactccgcttaaagtgaagcaagcgatctctgctctggttccggtacaggcaaacgcaacagaaagttcgtttggtcttgttcagttagcaactgttgcagaagttcgcgcaggtactattcgcgatgggtttgcgatttcaccatacacgtttattcgtctgactgcaagtgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcaatgaaccgcaattcaaacccagaactgtttgcccgaattggttatacatacggcggttctggtgatattttcaacttgcctgatatgcgcggtcttgtagctcgcggctttgatggtggacgtggtgtagatgcaggtcgcggttttggtacatatcaggctgatatgtttgcgtatcacgaacatgatctccagatgatttaccagaacggcggtaatcttcctaagagtcaagcagtttatgaactgaaaggcgcggaaaaaaatgaccaacgtgttatgcacctgaataacgattacagcaaagcattaggtactggcggaaatgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggggttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtacagattcacagccaacgagcatgaaaggccgtattctgaacctggaaaacacacagcgcgacgaccaccaggtactggttgatattaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgaactggaacagaataaagcctctcaccaggatgttactgatgctctggttccgtatatcacagaagttgaagcggataacaaatacgaagcgaagaaagttccactgtcatttactcaaaatctggtcggtcgtaacgattatatcgagggtgatgctatttctttatctgttaccgttacaggtggtaaactgccttatgtgtaccagtggaagaaaggaaccgcaaatatcgggactgattcaccgagtgtaattatccagaacatcacaacgagtgattccggcgtatataaagttgtcgtaaccgacgctgaaaataccgtgattacttctgatgaacttgacattgcggtacatacggttcctcagttcgatacaaacttgagtgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaacggtagcataattttaacaaggggcgcaagccccttttgaggatcatatgattacgaataatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtattgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtaggcggtgtacgagcgggacagggttcaactgttacgggcggaacgtctgcatataacaaccgctgggtaaaagactactctaccgcactggtgaaagagatcaacggacaaattctggctaagttccagggaatgcaattgcctggcggtgttgctcctgatggtacgcgactgatccaggaagcggaaaccaaactgcaaagtctgcgcgatgaactaatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacatgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttatttccctatggacaatagcctgtttgaaattacgtgggtagaagccgatccgttctatcagttcggtgatcgtcctcagcgtaaaatcaacctggctaaattcatctacactggtgaagaactggctcctgaattgcagcgaaatgaaggaatccatatcgaacctgatgcagaactggatctcgaaccgattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcgaaagtctataccctcttcgaagaggattttatgatatacgcaaaacttaaagaatggttgcctcatgatctatacgttgagtatgttgatatcataaaggcttctccaaaaactgaacacacagaaaaacatcacatattaccacgttctttatttcctgaattcgaacacgaaccggaaaatttagtagaacttgatataatgaagcatttgatggcccataggacattagcaaaaaccaatgatcctaaaatgattcttgcgttcttcatgatgttcacctatgaacacaaacgttattcatcattatctgaacaagaacagcagttcattcttgaagaaaagacaaaggcgcgaaaagcaatgcgcattgttaaaaaagaacagatgaaaggtaaacatgacggtaaaaacaacccattttacgggaaaaaccataccgaagaattcagaaaaagaattggtgctgttcataaaggaaagaagctatcaccagaacatatagcaagtctcgttgctgctcacaaaggcaaaaaacgagaaaaggtacaatgcccccattgtgggataatgtgcgccgctaatacagcgaagcgctggcactttgataactgtaagtctggacgcgtccagcagggggattagaaaatttttggatactggtataatagttcgctgcgtaattatatcgtcctgatgggggcgctttttaatcacgttcaggttaaaagagtacgcggcgatcaagaaaaatacataaaggttccgatcacctatgcatcgaaagagaagtttctcgcttccatgaacaaacttaactacacgttgagtcaggaaaacgttgctaaaacggaaacgattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccatatcgtctgattttcgaactgggtgtgtatacgcgatatgaagatgatatgttccagatcgcagaacagattttgccatattttcaaccgcatttcaactgcaagattaccgaactgcataagaacgaaatcacagttgaccgagacatcaaaatcagtctccagtcggttgcgccggataccacattcgagggcgatgcaaatcaacgccgtcatgttgagtggtcatttatgtttgaattacagggttatctgtacccgcctgtaactgatgtcaagggcgaaatcagaaccgtttacacggatttcttctctaacatgaacccgttagataaagataacttcgaatccgtggatagtcaagccgatccggtagatttgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaagggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactacccgacttcttgcagcctggtattgttgaatggaacaaaggttctattgaacttgacaacaaatgtaaaattggtgcgtttgcatcttctcccgatgcagtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcatttttgcaggaacactgcgcggaattcatgggaaccagtggaaccctgatcgctggatggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaatttttaaccagatcaaaacaactattgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtactaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggagctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagttatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgcgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccatccacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatatacttccataaaatcatgcataaagacgaaagcaaaggtatccgcgaactgcgtcaacttgatccgcgttcgatggaactgatccgcgaatctatcactgaaaccctcgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagtaaaatttccttcattttccagcaggattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggtaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtatcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggtcctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggtatcaacccgtttgcgaactctcgctctcaggctccggcagatcgtatcacctctggtatgatcagcaaagaaatgtgcggtaaaaacgcatacttccgccgcgtgtgggttaagggcttataagttgttgaaaaacaacgacttttaaagggaaccttcgggttccctttttgtttatataaataatgaaaactattgaggctatattatgaaacatataatttataaaataacaaacaagataaacgatagaatctatatcggcgcacattcgacagatgatattaacgattcatacatgggttctggtaaagcaatcaaagcggctcaacggaaatatggaattgagaacttcgtaaaagagatcttgttcgtgtttgatacaagcgaagagatgtatgaaaaggaaagggagattgtaaacctagatttcgtcaatcgtccagatgtgtacaatatgggcgtgggtggttctggtggccctatgctgggaatgtttcattcagaagaaaagaaacatgaaatctccaaaagaactcgtgaaagaatgacaccagaagtaaaagaacgcctttcaaaaataaaaacagggaagaagcaatcagaagaatccaacaggaagcgttcagagactatcaaagctatgtacaagggttctgcattcgacagaaccggatctaagctcacagacgcgcacaaggccaaaataagccgttctgtgtcgatagatggagttgtttacgcaagcggttccgatgcttctaaagcgttggggctttctcgatctggccttgattaccgtttaaagagtgacaaatttcctgaatggaaattcgttgcataaataaacaatatactccctataattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgatggtactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacatcctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgggactgacaagatgggttcagtcatttaggcggttatgtggtcgaaagattcgcctcgttgcctgattgtaaggttgtccatgacataaaacgaacacatcctttttaagacaacggttgtctgaataaagccgaaaacaacaaagccccttcctttcggttggggcttcttttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcatcttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttaccgaacgcaccgatgtattgcatcatgttcgttttcccttctttcagggaaccggataaacccagtttgaagatacattgatccatcgtgtcgataatctttttgatgctcatgcctgttgataggtggcattcatcaaccatcaagcacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacaccttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaagccggaactgctgatcgattcaccagaaccggaaatcgtcgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggcgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaatgcttactacccagttctgtttgtttgggctgatggtaaagtgaagaaagtagtcaattcaaatgctccttactatactgttgaagaagcactgcgtcacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggctacgcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctaccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatttgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgcaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacactttcaccaacgcttttcttttttgttctgctaccgcatcggaattgtatttccctacgctggttaagatcgcaacctgacctaaagttctcaaatgacagaacaggtcgatgccctcttgaagtggttccagattttcgtagaagtcagttttagatatagcctgtttcgcttttttcaattcttcttccggcattctcgccgggtcaccgtacatcggaacaaaagaaccttcccagttaaacagtacaccatccatatcgaacaaaaactttttcatatcaattcctcggtttgtgtgtgcatcatattcatataagttcctgttgtcaaccccatgtgtcagttttcggtgcgtatgctgcaactttcgccactaactctttatcaagctgatcaatggatttctgcggcttgccttttgccttaactttgatgtagttagacttaacgacaaacataccgcctttgtcagatttcttgatttcgctgtcaatgcctactttgttgaagctgatccagatatcaccgtccatgtactgtttcagagagtcgcccatgttcaggatcttagccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgctcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgatgcacccgcgcattatgttggatatggaagggtgggaaccaggtcatggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatactctgtctgaaaaaggcagaaagaaaaatctggatcgtgttttctttactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaaatcaaatccgcctgatgcgtcgttccaatcgtggatctatttccatcgtgaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgttctgcgtcgtgtgtacatcaataaacatcgtgaagaacagcgcaagcctaaactcaaagctaaacgcgatccgcgtccagataacaaacgtaaagcaatcaacggcgctatggcgctggcgttccaggaagcgggtttggcgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggttgcgcgtgaaaagatccacggggctaactttagcctgattacttcggacggtatcaaagtcattccggcaaaacgtagcggtgaaatcctccctgctgaacaattctacggttgtgaaccagtagttgcaaaatactctgaacctgttcgtaagatgtgggaaatgctctctgctgcccgtcagttaagtggcgtgtatagcgatgaactggtgattcaggtatacggcgaattcgcggggcgtggtgtccagaaagatgttgactacggcgaaaaagatttctacgtatttgatatccgtgttaatggcgaattcctccctgataacgttgttgcaaattacgctgttgctgttgacctgaaaatggctccactgctggcatacggtacgtttgacgagatccgcacactgcctatcacctttgattcggtggttaacctggcgaactccggtgcgatccctgcaaagaacggtgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcaatgctccttctgaactgtcagaaacagacaaagtgaagctgaacgaattcacctgctacctgactgaaaaccgtgtgaaaaacgttctgtccaaaattgacagcgcgaatctcaccgctaaagatttcggtcgcgtgatggggcttacggtacaggacgcgctagaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagcatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattctaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcaaaacataatggtagaaatcaatggaatcggtgtgaacgcacaggcgggaagcgggacatcgtgggtcaaacgcgaaacacaagatgatccccgctgtggacgtagcccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacccaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgaacatgagtgaagcagaatatattgatagctggggtggctatgacgatgacgacgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacctgtcctacgtgcaaagagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcagcgatgttctatattgaatctcgcggtggtaagtttgatgaagtagtaaccgctggcgttaacttcgttgcgcgggttcttgctgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaatgaagacgaagcatacaaaaacagcatcgaaatgttcggtacagggttctacgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccatgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgatactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctgttgaaagataaaaaagatgaacaccgtgctattgcaatgcttgagaaattaggtgaaaattattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatattttctctggttctggtacagttatgaaaatgtcgatactaaccaacagacggttcaaaggcttcgaactgatggagaattattatcacgattctattcttcgtgttcagccatacgttaacaatctggaatcttttctatgagttatttgggtgttatcccgtatacaggtaacaagcaatcgctattgcctgaactcttcaagctgttccccgaaagaagttcatacatgcgtttcattgattgtttttgcggtggccttagtgtgtcgttaaacgtccctaaacccgttctaagcaacgattacgataagacgcttattgatatgtatgagcgtcttaaaacgcttcctgacctgtctccggtgcgagaattgattgcatcaaaggggttggggaaagacaagaaagaagagtatttgaaattccgtgatgaatacaaccagaacaaagatccgttatggctctatgtcctgatcctgcattcattcagcaacgttaaccggacaaacgacaaaggcgactttaacgctaatttcggatgccggacgctcaacgatgcaacagtaaaacgctttgaacatttcaaaaagaatgtgaaaggtattgagttttccagtggttcattccgtgacattgatatctgtgaaaatgatttcgtgtactgtgatccgccgtacctgatcaccgatgcagtgtataacaagttctggaacgaagatcgcgaacgcgagttatatgctttcctggatgaactacacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacacaagaagtctacgtgtgcaactatcagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaatccctggttggtacgcgccggatgaccatgcctcagattttccatgacgggaaacacgtaggcggattcgaccaacttcgtgagtacgtccgcaccctgtaataaataatgacaccttactgaatggtgttattatgctgacgaaacgaattaccaaaaaagactacccaactatcaagcaagccctctttgaaaaacaaggtgggcattgtgctatatgtaaacgtcctcttgagggagagatcgagaaacatcaccttgaccatgaccatgctttagacggcgaaaacgccggacgtgtgcgcggcctcctgtgtaacctgtgtaacggtacagaaggtattgtgaagcacaaattcaacagatccggtcttgtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaatatctaaacgctcgattatcaacgcaacagaagaaaaagctgatgatgttgatatcctccactgacaaaaagatcatatctctacatgattggatgcttggaaggggtgactctgatttgtgttatgtcaaaccgaaagaccgaacgatgtttgatgatcgcggtcgcacattgactaatttttctcctatcaccgttattgatatgtgggaactccttgagattgtaggacgggatatacctgttgacggggttgaactgatcaaatatcttaacgatattggacacaatttagatattatccataaggcaacgaaatgaaagtagaaaaacgcgacggcaaaaccgtcgatttcgatcaagaaaaaattcgcaatgctgtgtataaagctggcgggactatgacggatgctgatgccgcaatcatgctggttcagtacaatcagatccgtgattttagttcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggtatggtgaatctgtccaacaaagagatcaccaacgagaacgcgaacaaagacgcaagggtattcccgacacagcgcgatctgctggctggtatcgtagcgaagcatttcgcccgtaatcatatccttccgaaacacatcgtagaagcgcatgattccggtgacatccattatcatgatctggattacagcccgttcacgccatacacaaactgctgtctggtggatttgaaaggtatgctggctaatggcttcaagatgggtaacgcagacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcatttggtgtccgtctgaatcctgatgatgaaattctggaactgttcaaaaatgggcgtagttctatcagtctgggttatattggactgcacgaaacgctgttgatgtttggctcaggccaacacccatttgatcgtatcggctcccagaaattaggccgattgatcattgaatatctccgcgctgcaaccgaagcatggaagaagaaaactggtttcggattcagcctgtattcaaccccagcggaatctctctgtcatcgcttctgtaaactggactttgagaagttcggaagcatcaaagggatcacggataaaggctggtacacaaacagtttccatctggacgttgaccgcaaggtaacaccgttcgagaaaatcgactatgaagccgattatcattacatcgctactgctggtcatatcagttatgttgaattccctgatatgaaaaacaacctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggtaatcacgatccggctaaaatgagcgtcacgcgccgtacatgcggttatctgggtgctcctgctgttcgtggtttcaacgaaggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagactattttgaatttcgtgacgaagaaagttttgggactgtgtaccgcaatttagctttgcgtggtagtcctctgtcgcctaatcaactatcatctgtcgtgtttcctatcaaggtaacgcactgcaaccggaaaggtgttagtgggatcgttgatgccaatggcacaacatggtattccgaagattcatatctgtttgataacgaggatcgcggattctttaaaaagtttgtcgcgattaaacctgctgttgaaaaagccgacgcgcaacaactgctggattgttctcacctgctgggacgaatttacgtagatggtaagctggtgacgaaaccaggtgatctggaaaaattcttgcgtaaggcgcgggaaactaccctgaaagagaccgaaaaacgttacgatactgcaaccgccaatctacagcgtttgtctggtgaactgaaagttctacggggtgaatgatgtttccattaaaggcgcgggtacgcaacaaaaccggaacacaagaatggatggagtgtttacgcgaaactaaacactactacatttcacaggctgtaggctatgacggaaagaacatccgttataacaaagtaggtggtaagcgtgtggggatggaacaatatctccaattagaaaccgtccggcctgtgaatgttcctttcgatctgaaactaccaaacggaaagccaacgatatgatcgggaaaatccttgatactctgttcccctcccgtgtacgtgcgcgggtagaacgggaaaaccgactcgaagaaatccggttcaataagttccttgaggacaagaagaagcgcgaagacgagaaacacccaaacgcaaaaatggctgagggtgtatcgaaatgttctgtcgggcggttctgggttgaaaaggattatcttgatctgataggtgctattgccccaggtgttacgctggaggacttctcccgcgctactggtcgttcgtataccggatgtatcaaccgtttgcgtatgctctctatagtggtgcgtagtgcgcatttcggctatcgcgacgttatccgtccggtgatcccagtaagcagattaaaattttatatggcgggtggaaaaagacttgacttgaccaacgaactgtgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagaccttcacagtggtaaagagtctgagatcaaaaaactgctggcggcggggcaggaagtgtccaacagtcattatgttctggcgctgcaacaccgtaacatctggcagggcttgcagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttctgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgaggattcttgtagatgggaatgttccacagcgagtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaaagagaggaaaagtgaaatgatgttcgaagacggcaacagtgcattcaaaccagcacgtaaaacttatccagactggcgcaaacagtacgcagaacagctatggcacattgacattcccgaagcgctcatgaaagcgattagccctgcggttgactactattcaggctggaaagatgaatatgagttagaagtcggttcgtttaaggcgcacgtcatcaaagcgaccagaattctcgatttcgttgaagctgttgcgtcgtgcgatatcgttgaagatattcgtattccttcaatcaacgtttctcggtatagttctccgggcaacattcgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgataaactttcttctgcacgaactgattgaaaacggtatcagatttgaattcgttgatccgattaacggtgatgatcgtcatctgctccgctgggtgtctggtagcaatccgctggattcagtatcccaggttgtagagtctgcgcttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacacaggcgctgaacaacctgttcccaggggcaaaaggctgatgaactttgaccgcatctacaacatggatatggtcaacggtaaaggaatccgtgtagtgttgtttgtcactggctgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgctccagcgcgtccgtgcgacgttccctgataaagatgtgtgggtttggacgggttacaccctcgaagccttacagggcgatacagaacgctctaagctgttaccattcattgatgttctgatcgatggacggtacgaaaaggatctaccgactaagaaaccgtttcgcggttcggataatcagcgaatgattgagttcaaaaagaattccatcgaaattaaaaatatcgcttgacctggtttgtagttctgttaagatatccacgtagcataaatttaacccaattgagagataatatcatgattctgaatttcaaaacccgtaaagaagcccgtgactattgctggaagtggtcgatcccgctgaaaaacatcaccaaaggaagcggctcacatccgtggacggtgagaaccaaagaaacccgcttcgaaaacggcaaaaaatacaagctggttgatgtcgaaggtttcaccaataacggcaaaaacaccgccaatagcgtacaggcgaaacagatcaacaaacatctggatggtgttgtaaccatcacaagccgtaacggtgacacctacacctttgacgctccggtcggtgttgcaatgtttacccttcgtgcatgggaagcgaaatacttcacagaagttgctccggctaaagctccagcgccaaaacgcgctaaaaagccaaaaccagtaggcaaaccgtccgtttctcctgcgccagtgaaaccagatctggattctgaactggatggtggtgttaacctcgctccagcgacaaccgaaccagttacaaaacctgctgtgccacaaccagcagatattgaagcgatgcctacacatttcgttgctggtcgtccgtatgttctggtagatgaagctggtttcctgcgctctcataccgcgaacaaacgcattgtgcaacacatcaaaaacaacaacggtgttatggtgcttgagtctgttgacggcgacggtgatgcatccatcacactagatcgtactctcccgtatattatgcatcgtgagcgtaagttcttccgtgaactcggtactggcacagttcaggcagataccccagcggttcagaccgttgatattgccaaacagcaacgcgacaaagagatcatcgaagctgcacaggcggtagaagacgcactgacagaacaccagaaagcgatcgaagttgttgcgcagaaagctcgcgcagttcgtgaagccgccgcaaaacttgcattgctggcaagtaagtaatataattcgggggtgcttacggcatcccctttttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaaaatggtgaattcacctcagaagaaccagaagaagttaatctgagtaaaggtgtagaggctgaaaacgttatgcatatcgctacgccggaagaggtttccgctggtgttgccggatcggatctgcgtctgatggagatccctaaattcacgtatcgccctgtacaggaaaatcctatgcgcgatctccgcatcgatccatcattcggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggaattcccgaaagtcttcataactgttacgggtgtatacaagcgcaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaactgaaacaacttattggtgattaaatgagccgtgaaattttactccctgctgcaaatgctgttcatgctgaaacgatggaatacatggagaaattcgttgatcgcgataataccgcgatcatcactcctactcacctggacgcgctcgaagatcgtcttcataagcagattaaagatcaattccctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagcggtaaaacaaaggcgattctgaaccatatcaatcaaacgggcgaaaaagcaatcatcgcttcgatttccatgatgttatcaaaacagtcttatgactactacatcaaccaggtaaaagggaaacgagcggtgattgttgacacggatcaccgaaccaaaagaaccaacaatgacgcgctgcgtgaggttgtcaaagattatgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagatacgattacagggaagatcttacaaacgtttcatgatgttgagttcaaagattcaccgcttcaaacgctggttgactttaagcaatataaaaacacgaagcgcattaaaatacatgtgctcgcagagggggattattcgcgttatacgggcgatctctctcaatctgggacgacaatatacacccagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctgggcttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcccgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgatggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcaatgacggtctccctgttgaatccggtacgtacttaatggctgacggtcgtttctctgaattgacctatattctgccagatgcccctgttgagggtgatattatcactattaaagatggtggcggtcttgcagggatcaacaacctgttagtgcgttcaaacactcgtcagatccgtttacgtgatattcagtcaagctcttatcgactgactcacccatatatgaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgctacgcaaacgatggtgactcaatcacaacttacgatctggatcgccttgcttcggtgaacgttgcgactctgcaagtttatcctggtagcggacacacgatcagctatgacggtatcaataacgtaacctctgtgacttcacagcgttccggttatggtatcttcatgttcgatcaggctaataaccgttgggttgtttatgacggtgatcagcgcgttcgtctgcgtcgtatcagtgatgacctgaacatgttgcctaacgattacgtgttcatcactccgattgctggcaacccaccaactgtacgtaatgtaacgctgactcttccgcaagatgttgcagaaggtgatcgcgtatatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagctacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgatcgtgacgcctaaaaagctgaacgaacgatcagcaacagaagatcgtcgtggggtgctggaaatcgctacccaggcagaaacaaacgctggtactgatgacactaccgcaatcacgcctaagaagctcgacacgcgccgcgcgaccgaaaccctagcaggtatcgggaaactcgttacaacgggcgctacgacagcggagggggctttacgtggggatgctggtactaacgtctacaacttcaataacggtgttgatctgatcaccccgaaatcattgaacgagaagacggcgaccgaaaagtcaaaaggtctggttgttctggcgactgaaaacgaagtggtaactggtgctgctgctggatctgcttcaatgccgatcgtagtaactcctgaaatgctgcatcgtaaaacgtctactgaatcgcgtatcggattgattgagatcgcaacccagacagaaacaaacacgggaactgatgatctccgtgctgtaacgcctaagaaactgaacgatcgcaaggctactgaatcgcttgatggtattattgccctcgctaccactgcggaagttgcagcaggtacggtaacgaataaggcagttgttccggttaagctgaaagagttcttcgacgttacgagtcatgttgcggttgcaactgctgatggtttaactcagtccggcactatctggacaacgattaacctggggattgcgtctgctactgaaacacagcgcggtactttacgtgttgcgactcagggtgaaactgatgctggtactctggataacgtggtgatcacgcctaaaaaactgcaagcgaagaaagcgacggataccgccgaaggtattattcgttgtgcgactaacgcggaagcgggtgcgggtactgctactaacctagcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaatcagtctgcgaaagcaaacactgtttatgcaaatactgttctgagtggtgaggctgcgggaaccaaaaacttgcttcgtacattccgtagtggcgtggcggatacgatctggcatgaaactgttcaggcaagcacgtatcgcctggcgacgggtacaacggatctggttgacgttctgacagtaggtgatgtcggtaacggcacaatggcgtattacggtacgaacattcgtctgaatggtaaagctctggctaatatcaccacggggggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtaacgggtgatactatgactggtgcgctgtcagttagcgtaaacggtacgggtggacgctttaccagtgtgagcggtacggcacatgttcaggcgggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccagcagaaatcggggcggtagcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgaatgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttactggattacaaatcatttgatatgtatggtgatcctactacgaacgggaatgcgattaaagactacctgaattcacttccagcgaacagaattgtatgtttctatactttcgatgcaataaaatcgactgatgcgtttttaagttatatgcgcacaatcggatctgttgcatggcctgaaacacgattctttagcacgccgtcatcatcaacaaacaacccgcaacgttcatcttattcagcaatctattcatccacgatgaaaaagatctgtatggaaaactttgtaggtggttctggtagtggactcaaagacaacacgacgagttttgttgaggttgtattcgatgaattcagtgatatcggggtaactggtattcctgaaagaatggttgatgatgttcaggtatatcagaacagtggcagtgcttacggcttccatttatacgggatgtgggatattggttctactgttttcttgggggacatcttcaagttcactggtgatgtttattgctcacaagaacttcgcaatgctggcggcgaatgttatctctatatgtggacacagaacgcctctggtcaatggatatcctctacgatcctgcgaacgactgggttagctcctgatgaatggcattctctgtcaggatatttcactatccctacggacgcgctaaacgtgaagatgggctgtatggtatatcactacccgtctaccgtgaaagtggggcttgctcagtgtcgcaatgtccagatcagcaaagttccacgaatcgaaaccgatcgcaacggggcggcaattggtgtcaatggtatcaggatgcaaacgctttccgaagttgatgatgctggaacccaaaacccgattgataaattgctttctctgcctgtttcgcctactggggttatcagtgataagaaaatcatttcgcataactttgctgaacttgattatattgtttctgatccggttgaatacacttcgacaaatacagcggagtaccagttcaaagaatggactactacccagcaagcggcggtaacgaaagcatcactaagcagttatggcttaaaagctggtgatacgatccgtatgcaatgccaaatgaaacgcgatgcaaacgcaatcgccaacaataaagatgcatatatcgtaatgcagttctgggacgcgaataataagtatatttcagggatccacatgcgtgatgttggtacgatcccgaacgtatattcattctataaaaacgaaggggttattcctgctggtgcggttacgtttgatttcggtttatatcgtcatccaaacaacacaaacatcggtacggtatccgctaaagacgttaaactgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgcactatcgacgattaacggcggtactgttgcgaagaatactacgtttagtcaaaacgtgacagtaggcgttttgttgatcgcaaacaatattcaatctaaccagtgggtcaggatcactggaagtgctgttgctccggcagttgttttccgtcgttctgatattacttcggttcctgatgtggaatctgggttgatggacattaacgcatacagcggtatttctggcggacagttagcgggtacaattaacgtgaacgctcgcacagacggaggtaataaaatatacatccgtgcctttaaaaatggtactcaaaatacgctgttgagtctggactcacaaacccaacaggtaacagttgaacagggttctttccgtgtgatcgggacttctaacctcggcttaacgaatgctacatcaatggcagttagtggcgcggttactgcgaatacagtaactccgtcaaactgggctaaccatgatgaacgttatatcacgggtattcctcgcggtatgtctggaaacagtttcggggctgctgcggttactgaaaagaacgatgttctgtcggtaggtggtaacgtaacggacggtccatatggaaacacaacatattacggtcaggttgccacatatcgccgtactctgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtgttctggctaatgacgggaacgtgtatatcaacaaaagcgggtttgcaggatggatcgatgcactgttcttgaaaaatacaggaggcacggtaacaggaaccatcaaccaaacaggcggttattttgatgcatcgggggaaggtagaggttcttgggcttctcaaagcactgcaaaagctccgattttccagaatattaacactacatcgacatctgaatactggcctattattaagcaatattattctcaggctggcggtgcgtggtctatgggtacgttggtaaacaccaacaggtttacagtccattaccgtactggatcggtagatcgtcaatggtattttgataactctggtgagtttgtatcttatggtgatattatttccaactcagccaacggattgcgtattgcatacaataaccgtggattctttatccgaaatgacggtggtaacacctatttcatgttaacaaactcaggtgatgcatggggaagttataataacctacgtcctttgtatataaataatgatactggtaatgtctcgatgggacatacgttatcagtcaacggacgtatcagccagtcaagcagttatattgacaatggaaatttaacattaaacggtagtggcaacggacgcgttgaatttattcgcagtggtgcaaaccctcgcgatatgtatatcttccatgctggtgatgcttctcgtggaaaccgtattgaaatctctgatagtgcatcatatctggtttattttgaacgcaacccttcatccggcattcagttggtaatgaacggtaacggtagctttagcgatgtgtatattcgttctgatgaaagactgaaaagcaatttcagtaagattgaaaatgcattggataaagttgatttacttgatggtatggtgtacgacaaagcaaatcacattgggggtgaagaaactacccgtgaggctggtttagtcgcacaacaactgcaagaagtattaccggaagctgttaagaaaggtgttgatggtgaacagaacgagatcttaactgtttcttcttctgctgttatcgccttgctggttaacgcagtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccgacaaaggcagaaatcggattaggcaacgtaacgaacgatgcacaggtgaagaaagctggcgacgatatgacaggcaacttgacgttaacgaacaatgcttcattaactcttcctcgtcgcattaaccttatttccgataattcatcggcggtgtatactgtagcaacgcgttcggataacaacgcagttacagatccgtttccgtcatcggaaactcgcgtatacagtttattagttaataccaaatcacatacaagcgatcctgcgggtggtgctactttagccgcacatctgtttaaccagaaagcatccggtgcgggtgtgatgtttatacaggtatttggtccacctaataagacaacaggcgcttctggatcggtgacagggcaactgttgatgaacggggaaaatggtcaactacaaatgactggttccggtttaacgatcgggatgcaaaccgttgtcagtggtactatttttggtacacaaatggctattaaaggcgattcgaaccgaaacctatacttccaggatgctggaggtaatgaactgggtttggtctacgccgataccggaaagaacgtatatgttcgtactggtggtggtgcatatgcaactcgttttgcatatgatggaactttatttctcgctaaccatctaaccgttcctggacaggctacatttaatggtctgggtgtattcaataaccgtgcttctgtaggcgtaaattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggtactaccgacgcacaggaagaactacaggtttcgactgctggttatgttcgcgcccgtgcggaggttcaaagtacatcgagtagttcaggcggacaattccgcgctgttcaaggtaactatggattctttatccgaaacgatggcggtagtacttatttcatgttgactaattcgggagatccgtatggtagttggaacggccttcgtccattaacaataaataacggaacaggccaagtttctataggcactcctttagttgtaactcattattcaggtctcacggttactagtacagcaggtgatgctatttcttggggtaacgcaggcgctgccctggcaaatgacggtaacttaaagggaacgcgctggaaatcttttggtggttctgaatgggcgggcgatgctttaaactgggttcattcaaataatctcagtcttggtggcggcactatgactggcacattaaccatgaacgccaacattaatatgcaagaagttgaaaaccgtggtattagcctcggcaacggttctggtacaggtattttccaaggccgagacgccgccgataatgattacgctaatatcgaaattcgttcttggtttggtgtaggctttaaaaacactcataactctggtgcagcgtattataacaaaaacaccatcttcatgaaccttcgtgacggtacaatgcaggcttataacgtttatatccgttcggataaagcttataaggaaaatcttaaaaaaattgaatctgctactgataaagttaatcaaattaatggttatacttataacatcaaagattcaaatgataagacacgtactgtcggtgttattgctcaagaagttgaaaaaattcttccggaagcagtaactatgaacgatgaaggtaaacgtcaagttaactataacggtctaattgctctccttgtcaactcagtgaatgaactgactgctcgggttaaagaattagaggctaaatgataaaagggccctagcggcccttgaggaaataatatggcaattgtaggtgtacccggctggattgggtcttcagccgttgatgaaacaggtgaaagatggatggcgcaagccggagcaaaagtgagattaacgccaccattttggatgtctcgaatggcgggacaatcggtatataacatcaactttacggtatatgaacgttactataacaacgcccgttatcgtggtcagtggggggttggttggtattcaccatattcaaaaccttccggttatcctgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatatcaggttatttcttctcaggcgaccagatggtatgactatctgaacgcccgtacaggtcagaaccgttctggtttggttacgcaacgttaagtaaattcctaaatatgttcgggggtcggcatccccgaacttgaggattaaacatggcgctattacaagataaattggcggtgcttgaacgggtaatatcgttcatcatggcagtcaaaacatggaaacagctattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgcatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcaccgatacgaagttgatgaccgtgtgcaatcaggccgcaagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcgggtcaagttcgtcgttgttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccattcgatcgaagtattcacgcgctttcgcttccgctttatctgggtcagtagacaggttgcagatatagttatcagaagtgaattcacctccacgacgctctacacgcagagtgtacatagcgtttttagcgccagaagaaatgaaatatgtcgcggtaactttagtcaggttagtcatggtgaatctccttagtggtttcgtttcgacaaggccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggattttatccgcgatacgtccggctcgtgttgcgcttgcggtatgatcgctttctttggtagccagttcagccagcttacgctgatgttcttcttccgctgctttgcggtctgctgctacctgttcgacctgcttctgatcatgcgcaatacgcgcttccagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagattcgagaaaccgaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcaaatcctccgcgcctgaatcgctccaggcgttgttgtagggttagtagtgactaaatcccacagtcacatcgcgcatcacctgataacggcatacacgcatcttagcgttatcgtaatcagtggggattgctacaacatcacgcgggttaactttaacctgaatgacttttccacgtccgccgccatagtgaggcagatacgatttagccgcaacatgcaacccgcatgaacaggttcggtttttgtcctcgtctacctggttacgtggcatttcaaccacaacaccaggtgagttatcgaacttaccggaagccagatcgcggaagtcttcacgaacacgtttccacgcgtagaaatccccgtcatctgccagttcgatatcgttatgcaccaggaatccgtaaagctggtacacagcatcgcgggaagggttttccatcaacttctcgaagaagttcaccaggtgctcataagggcgatcgttatacatttcgcgaacgatacgttgcgtgatcccgctgtcaaacacgatatctttgtacaagactttatgcccgatgatcttaatgttgcctttactgtaaatcttcaatgcttctgttgtatccagcagggtagcaactccctcgatatcacccttaaccattaaagcatgtgctttttcaaagttaggatgcgacgaatcagcagtaacgattttaccattcaacaccagagtaataaacgattcagaaccgatcatttttgaactggtatctgtaaccggaagtggtttagacggttccggtttgttgtatttggcgtgttgttcggtaataacgcgcccgatggttcggacgcttacaccaaattgtttagccagggcggttttgttcgcgctggtcagaaagccctcgtagactgctttcttctgtacatcatcaaggatcttaacgtttctcattatttccaccgtataaggttgaccaaatccatcgtaagtttttcgtcattaaacatactgcggaatgtagaataagacgaatgcaataacatgtaatggattgatgggttgcgttctgcaaataaatcgtaagcagtatcaacgcgttctttcatatctttccgcattttgtaatacttcgttgacatttcacgaagtaaagggttacgtaccacagttttagatttgtttttgccctcgatcgtatcgtaggtaaacttaccatcaagataatcaagcaacaaatacaattctggattgtatcggtttttaaccatacgatcaagggttacacccatagaatcacgcagggttcggatctcgcttccgtggttcgatgaaatccacgcagggaaccagttaggtttcatcttcttcgctgcgtctgtaaaacgttttaccagataatcatcaagacatttcatgttgctatctgaaatgcgactccacagagagtttcgcagaaccatcacatctttcagccctgtgacctttaacatggtcatcatactgctggcgatgctacccagagaatagtttggtgattctccgtccagtcggctatattcatcaaccccatagaggcgcatcgcgtacatttcacccagattcatgaactgtgctttagtcaggtacagatcgtttttctgtaagttgccctgttcatccaggaagtaatgatatgcagtcggcgttttcgggcgcgattcataatcaccagaagatgattcacgcgttgctttccaacgcttacggtcttccgtgtatgtttcaaattctttcgtcaattcactggttttcagcgtgacaatttcggattcatcgtaatatccagttttgatcaaatcctgtaccggatcgctgttgatctctttcgtcacgaaactgatacgatcagaaccgtgcatcatgcaataaccgatcaggtacggacggagtgaacgcgcttcattgtcgttttcaacaatgaacagtttcttctgtcgccacggttgaataattcgcataacgtcctggcgcttggttgtttccgctttatacttctcataacggcgaccactgcctacgcgctcatatacgcaatctttcccgtcatatgggttagcccaaaagccccagatatattttccggttgctgtatcagggtttttgatacgtgtcaggatttccgccagcgattctttacccacacggaaacggttatcgcgggttacaaatgtctgtaacaaactaggcagattgttgaaccatacgagtttatcgcgggttgtcttctgctttttgtactgttccatcaactcttcatcgaagcgtttgttgattttgtccagtcgatccgtaatcacttttttggtgactttatcaaggcttaactcttcgcgggacggcatgaagtccagcgatcccagagggaaatccagaatatatgcataattgctgttacggtagcaatagaacagtgagttttcgaacatgtccaaatcgattggatagcaaatgttacccatacgagcatatacgccggaatagtttgcagacttataacgaatgatcccgcgatcgtctgcttcttttggttgccagttaacatcaatctgaacaccgatgaagcgaggacggatacccgtaaacggttcgtaaacacgcgccgcttctctttcccattcttcgatatcttcgactttaaccggaacggtgatttgaacgccgttaggttcgtctgtttcgatttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaagtaggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtaaatggttgatgacatgattttgtatgttttcgcactggtagccattttaaacttcgtgcgttcgcctttatcgaagcccgttgtgtgaatggtttgtggtgctaactgacgtaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaagaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgtttgaaacgtccgttgattttgaaagaccaatgagataagccatgcttcgccatgatgcttttggcccaaatggttatttccatatcgctacgagttttgaacattttatatcctccccaatcagtgaggacactataacaaaaagcctcccgcaatgcaagaggctttttgtaaattatttcaatttcttcgaaagttctttcaaatcattgagatattcagttttcggggtcgtttcttcccagtatttcagttgcttacgcagttcgttcgcttcgtcttccagcttttgacgttcatccgtggttagatgatagatgttcatcgcaaccagaatttcggcgtggttctcgcaacccgtccacgtagagacaagtttaaccgcttcgctgcgactaagccccttcaatgcgtcaggctgtgcgatcatctggtcgatgaagtcaaccttcgccagcgctttatctaacgcttctttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtattcgcgtttcagggtgatttcgtagcgaaaatcttctttcgatagatccttatagcttacgatataccctttctcttccagcttatccaggatagagatatatttcacgcgatcgtacttgaccggaatctctgtgatcaccagtttggttttaccctggagttcatacttgccgtacatcgtaccgttttcaatgtcacctttgaaatgcgggtatttcagatccagtgtgaaatctttcccgttcaggtaactaacacatccattcagaaccgaaattggatcgtgtggtggaatgttggtagcgtatgctttcgcgatcccgctgaacccgttaaccagtaccatcggaatgattggtaggtaataggctggcggtacgtgttcaggatcttcatgcggaattgttaaatcttcatccatgtagatagccttgaacagcggagacagcttacatttaatgtagcgtggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagggcaaacgtaagcccttctacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttgcgtaaagaacccagccctttgatatatcgtacctctttcgctttatcgcggaacggtgcgaaatcttcaagggagtagaaccatttttcatctttaccgactttcgcaatgataatcggtgtgcggatataacggatctttttcttctcgaacaactcaggccagcgactaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccctacagcggaatcgccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccaatccgttaacgaaggatttctgtttgaaaccgtcttctgtgctcgccaggatgaaactgattttgttgtttgtctgggtaatcgttttatcaccgtacatcgcgccatacatcgcgaatttgttcgggaggatatcaccgttatatgtgaatttaacggcagggaaagccactgcaagcgccataaggcgatctttgatgacttcctttgtctcttcgtcgataccgtccacaccgaaaatagagaagtcaggggtaaacttaacggttgtcccttgctccttcgtcgggctggtgcggtaatccatgttctgcgctccgtccgtacagttgatcgtgactttgcgtttaccgttggatgtctcaccgataaagattgcgctgtaacagtttgtcaggaaagaaccaacaccgttcatccccattgttacacggttttcgtcatcgaagttagaaccggatttagccattgtccaggctgcaacaggtttaggaacaatcttcccttctggcgttctcacgtcatcttgtggaataccgcgcccgttgtccgaaatagtaaccagattgtgatcaatcttgacttcgattttgttcgcaaatttgaaatcagttcggatcgcttcgtcgatggagttatccaggatttcgttgatgattttcaccaacccttcaacgtattccactttgcggaatttacccatgataaaacgttcatgggcttctttgttcactgaacccacgtacatgttcggacgtttgcgaatgtgatcgcgatcgctcaagcagaatgattcatccaccttagcgccctttgtcggggcttctggtgctttctgcggctcgttatcgtccattaagaaatctaaactcatattcacctctttattagttctcaggcattatatagggttctatgaaaaagaaaacccctttcggggtttaagcatctttgattttttgaagaatgggtatcagttcttcaacttgcattcgtgttaatgagatctcaaaaccagattggttaatccgcgttatttcagacacagattctgaatcaaattcaataaccagtctatcacaatactcttgcggttgaaacccatcggcatatccgtaatcgtcgggcacaatttcgtttattttagacatagggaaaaccatctttcaccatctgcggcttatcaaccgttcgtttcgcctcgcccccgcaatcacaatctttcggttcgtcacggctcgcgatgctggacatcttcgggaattctttttcgcacttggtgcatttataggtatatgttggcattaataaatctctgacaatggaataaaacggatcggggttgcggctttgctgaaaacacattgtttgttccctgcaaacatgagatcagtttcgtacaccatacagatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcaagatactcatagagatcgtcttcatcaccaacacaacccgtgtacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgttgtcccgtgggtagtacccagtttcaggtaaatcacatccaacgcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggatcgtaatttcagtttccggttctggtgcaacccataccggattgaaaagccctttcatatcgttgaatttgataggaacgggaataccttcaagataaagaatccccgtttcttcatacaccatactgatccggcgtggtgaattgaagtccatcggattcttacgcaacgcgtcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccagggaaatgcacacattgcatgacgcgttcagccatgagttcttcgcccaaataaacagaggtggtttcttcgttgtagtggcaacagtaagaagttttaacactcataccaggcaatccggcgatatgcataaactttgagttcgtgcatggtttaccctcaatgctctttccgtttacatcaaacgttgcaaacatttcggttttgctgttctttgggcgtctgctcatttattcacaacctcattatatgttttcaggttccattcatgcacttctggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaactggcggttgctgatagtttcattttaatttccaaaggggacgaagccccgattttagcgaagatagcgaacgtatccactccggtcgatcgcgttctctgggttgttgaagatgttaccacgaatacccttagcaggtgctttccagccagcggctttcaagatatttccgtcattgtcgatgaagccagcaactgaacgctgattgaacatttcacccgtttctttgttgcgggtatcctgcacgatacggtgatacttacggcctttttccagaacgaacacagtttcagtgtaatcactgaaccacatgccagtgttacgacctttgtgcatcgcgtccagtaaaggctgtgctgcggctttcagttcgtcaaaagtatacatggtaaaatctcctaagtgtgtttcgtttcgatgtgtgtaatatactattatgcgttcaggattgcaagcattattttggttgttcgcaaatattgctcaatgcatcgcgtttaatgaacttcaatacacctgctttagcttctttctcgtcttttgcctgatacaagaagcagtcttcaccatttttagttttgacggtaatcacgaaagttttgtagttcatgcgtagttctccaggttagccaaattttcttctgctttagcaagggatttttctgcggcttttttcactgctgcatactctttcttttcccatgctgcgatatcgctgttcatcttctcgtcgcaataggcgatgatgcctttgttgtcgttgatctgctgaatcaggaatttgccgtgacctttgattaaagaaccgttctgcatcatgataactctccttccgttttgtttcgatgggataactatatcaaagctatcccgtgaagtctttagcaaaaagtgctatttgttaaacccgtttcccttgataccatttcgggaaaataacccgctcgataaaagttctccccagattgaaactatcaccaaacaggaggacaccaaacaaaggatcgcgcttgatatcgtttttcccgacagtcttcattttcccttcgtggatcacggtgtcaccaaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcgccggacacacaagcaatcacaccaatgatcgcgaatccaattaaaatgttcaaaccttctttcaaatcaccaaacatgttttatcctcttttgtttcagtccctacaaaataacaaagcccctgcacgaatgcaagggctttttatcataattcgactaactgaggcaatttcagaaccatccctggaaggatatagcttgcattgctaacggttttgcggttcaacttagcgatagactgccagcgctcaccacaaccgtataatttttcagctattgaatacatgctatctccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacaggtacgcacatcgcgactattccagaacacggtcggcatatcttcgaagatgtcgatcttaccaaccatcttacgcacgatatcaaccaggataccgcgatcgaattcagggccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgctaccaattccgcgaacgttggcgggttatgtggatcatcaacaaacggaacgtatgagagttcgatcaccttcccgttcggggaaggaccaaccgtttcataatcccatacgtaatctacgggtaaatgactcatgaagttctccgcttataatcttccatgaagtatgcaagcgtaagcgcaacttctgggttgatatcaaaagtttcaaactctttgctttgcaaagtcatcataccgaactgacgcagaccggaatgataaattgccttttccagacgattcgcgttttcaacagcttctgtgaattcgtccaacacatcacgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattgatcataagtcagttcgacttcttttgcaataggactccatgaataacttggcccgttcggagaatacagaacatcgttagatttttcaatgaagcgcaaacggtgaataacttcttgcggatctgctgcgctatacatcccgaacatattgaacgcatgtgggtctttttctcgaattttatcgagtgcttccagaattcggggaatgtcttttacaaggatagtcaatttcataataacctcaaaaggggcaaagccccttatacataatcaacggtgtaacgtgcgcgggttactcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgctgcttgatgcgcttataagtgctcgcaacgtaggccagatagttacccagacggtctttcatcaccggatcaacaacaacttgaatctgtgcttcggtttcctcttcaagcgataccgttttcaggagatagaattcaagttcgatcttctcgtcgcacttctccgccttgattacttcccgacgcgggatgatttctaagactcggattttttcgttgttattatacacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagaggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcaggttatcaggacgtggaacccaattcagggtatcagacaggctttgttgtgcatggttttgcaagtccagcatcttttgcagcgggtcgattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattgtctttcaaatactgcatgatttcaagtttagttgcgccgtcagtttttatcatttcgttgatatcttttgacggccacgggcatttgtcccacaacacaactttttcgccagcctcaatcaattttaaaaggcggtgagtagtatcagggtgacgggcttcattgtcaagcacccaaacacgcatatttttatacggaacatcggacagcgccatttgtccgcccgtaatagcccccgcattatctacaaacaggctatccaatggcccttcaagaaggtagacaggtttcaacggatcgatggtatcttgtccatacactttcgttgagtgttcacacgctttgattgtcatgtattttgcgttggcattgtcacgtaaggcacgtccctggaatgactctattttacccttttcatcaaagatagggatcaccaaacgcggttcatccttcggtaaagggtatgcgtccgcattcacagagttaaccaggtgttgccattgacgcgtaaaccagaggcgatcgtatttgtctttaggtatgtgacgacctgcaacatacttaacgatagggtgattttctggcaacgtgtccagacgttcgcagaactgcaattcaggaatatatttcttttcttccttcggcggttcttcgtgtgtctgttttaaatctttacgatccttgaaagattccatcaaatacgccgtataatcatccgggtaataatctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattt

SEQ ID NO: 155 - DNA, 179344 bp, Unknown
  source: /note="Description of Unknown: M16-7a Bacteriophage Sequence"
cgcgggatcacttccctaagttctatacccgcatcatggaagaatataccgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaggaagcaaaaaactggatgcagcgaatgaaagatgtaggcatggaagcgctaggcatggatgatttcaggctggcgtatatctccgattcctacagaaaggaaatcgaatacgatcgcgacaagatccgcattgcttcacttgatatcgaagttaccgcgcctgaattccctgatccacgcgaagcaaaatacgctatcgacgcaatcacccactatgacagcgttgaagataaattctttgtgtacgatcttgtcgagggtggtttagatgaatgggtagcgtcaaaagttgataccgaaaacgagatcagcgaagaagacttgaagaaaattgtttaccgttcattccagaccgaaaagtcgctgatgtcggcttatatcaaagactggaaagagcggacacctgttattgttacgggatggaactcaaacaagttcgatatcgcgtatatcatcacccgttacctgaatatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccaacttacgctctgggcgcgatcgctgagttcgaaacaggtaaaagcaaagttgattacgaaggttcgctgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaatttccctggggttatgtcaccgcttaaaacgtgggacgcaatcatttacaactctctgcgtgaagagaagaaagtaatcccagaaaacaaacgccatactaaaacgccgtatgatggtgcatacgttaaagatcctgttgtcgctccataccgttacattgtatcgttcgacttgaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaactcgaacacctgacagacgcgcacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaaataagttcagggataacaaccattgggttgacttcctggataagttcagtaaagaacgcatggaacctatcattgataagggctaccgcgaactgtgtgagtacatgaacaacgtcgaacacctgatgtttatggatcgcgaaatcatttctggaccacctctgggatcgaaaggcctgggtagtttctggacggctaagaaacgatatgcggctaacgtatgggactccgaaggaacccgctacgagaaacctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgtttggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaactcgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctatgattcagagaaaggcgtaactaagtcttacctgaaatcaatgggcgttgaccccgatcgtgtggtgtatactcgtatcacgacagttgagcaacttcgaaatgacgttgtaagccagcttaacgcgctggaacgcggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactcgatcgagttctggaaacctctgttcactcaccagccattccttgatgccattcaggataagtaccgtattcctgacaaagagatcactgacggggcagcactcgaagatctttattccgacgatgtagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcccaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccacttcaaagcgctgattaaagagcttaaattgaagaagggtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagtatgggcgacgttgccgaatctgctggtcttccagcaaccgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaacgcttgaagaagcacaaggtgctatggtaaaacaagctgaaactaaccgaagcagtaagttagccgaagtagcaaacagcacagacattcaattttaacggggcttcggccccctccaaaggtatagtgaaatgaaaaagattctcgttattgtgttcctgatcctcctgtctctgaaactggcagcaatcggggttatggcaaatgcttcctggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaaccggagttcgatagtccgtatcgttccgaatggatcgtatcggttgatgataaaggctatgtcgatatcatgcgctggcctaatattcatcctggctatctggacgaaggtatcaatgcggaaatgctgggtatgcctgaacaggttgaagatcctgctggggtgtataagtggatttgcagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggtgcattctttaccccgatcggacttgctcgcgatttcaccattgatgcttgtaccagtggaagcgttgttgacctgtgcgcgggtatcggtgggctatccttcgcgatgcttcatatgatgatgtacgccaaaccgcgtgaaatcgtctgtgtggagttaaaccatacatactataagttgggtaagcgtatcgtaccggaagcgacctggattaacgcagacgcgttaacgacggagtttgatactatgtttgatatggcgatcagcaatccgcctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgtggcattgataccggatactatctggaagaatggaaaggcgtgaaaccgatgtgtgaagttgtctgtatggaattccctgaaccggaaccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccgttccatcgctctgtaagacatatcaagcgccgtttaaacgcggttccttatatgtctgggttcatgaaccttacaagcgcgtatgactctctacggaaccgttggaatctgaccgagcaagaacacgaagagatcatgatgaacctcccagaacttcgcgaaagactcaacgaagaaatggttgcaggtgattcaggcggaagcgtggataacattgcttcgggtgtgactacaggcgcgatcacgaacaaagggccaaaggttctgggttctacgcgtccatataaacgcaaacgtaaaatcatgaagagtgaagaatgaaaccattaccgcctttgaattaccggatctgggttactgcgaacaattacacctggtttccgatccgtatcaagtacatgagcgacaccgcgatcgtgtacacgaacgaaagaaaaacttcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatatttccgtcaaaacgaggcacacatatgatgtgtggttgttttaactgcaactacagcaagccgttttctgtgtttctgaaagactattacccggatgattatacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccacgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggtgcttgacaatgaacgacatcatccagatactaccgcaaggttaaaaaaattgattgatgctggagaaaaggtcgttttatgggataaatgcccctggccgtcaaaagatatcaacgaaatgattaaaagtgatggtgctaccaaagcagacattgctaagtatctgaaagaaaatacagtgtccggtttaactgcaaagttgagattcaaccaatgggatcgaagtccgaaaaagaaatagatggtataaaggatcttctgactaaggttagaatagattacaataccggaaaggtttactggcttaaaaatggtatggaagctgggacaaaaaccaaaaagggatatacccgcatcgaaacaaaaggtgtgaaatatatgcgtcatcgtgttatattttactcgcgttttgggtatctccctgatatgattgaccatatcaaaggcgttgatgttggtgactttcctgataacttgcgtccagcaagtacagcggaaaacaatgcaaatcacattaacaaacgtaaaaacaacacaagcggttccattggtgtataccctcgcggaaaccgattttctgcaagtattcaatataagggcaaacgaaaacatttgggttcttttgcaactgttgaagaagcacaagccgcttacaatgatgccgcaaaagagattttcggcaattttcataatgaagagacaaataaatgactgataaaactcctgtttttaatagctgtgcgcacctggttaaccctgctgatctggaatttgttgataccgaatatcaaaaggttctggcacgtaacggcgatcctctgcaatcaatgctggatctgcaaaaccacgcacaacaaagcctgtctgataccctgaattgggttccacgtccgaacgaactgaaaacgtgcggtgagatcctggactggctgaaactgcaagatgatgcgatagcagacgaaacccgcgaactttacaccgctctgggcggtatgtctcgcggcgcaaaacctgcttccggtgtctggaaaccgtggaaagcaaatcaccaggaactgcgcaatcaggtattcgcagaaatgaaagaagaagacaaactggaaatcttgtttgaactgattgaccagtggcacttcttcatgtgtaagttcctcgcgttgggactggatgcggaaaccatctacaagctgtatgctctgaaacaggcggaaaacctgcgtcgttgggctaacaactactaatggaaatcaccgcgctacatgccgtatttgctttgtcttatatcgtctgcgcggtgataacgtatctcttcggttggtgcgttttccacgttaacggtgttgacagaaaagccgctttgatagtattatcattgctatggtttataggttttttctacgtcatctatgaggggcgaaaatgattgacaaatactatatcattgttacgaaagacaaagacggctttactattccatacattgaaaacgggaaaacgccggaactgtttgcatcaccgcaacttgcaaaagataaattagattttatccgcaagtgctacgaaaccaaactgaactacacgccggatgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgttatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcagatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtatcacaaatcacaggggagcacgtatgaccatgcgtatatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaagtctaacgatgttctttattctccgaacgggccaagttattcatggtctcctattgcaaaagaagttgaactgacttatgatgaatatggcgttatcgtgctgatccttagaatggcacgaaacattcgtgaagataaagacatatggacactaatatcatgaaaaaagatgtatctatccagatcccacgcctccacgcggaagcaattgcagacctgattttcaaaactccacgcacagaccttccggtgaatattgatattgatttgctctatgaattcatggaagctgttgaaaatgcaagccgcctggaaaaagcgatctatcattgcggtttgcgtcagttcggaatgatgtcaatggctagcgaagagatccgaacattcgacatcaacccagaagttgcgcttacgctggcatacttcatggaagagtacaagcggagaagttcatgagtcatttacccgtagattacgtatgggattatgaaacggttggtccttccccgaacgggaaggtgatcgaactctcatacgttccgtttgttgatgatccacacaacccgccaacgttcgcggaactggttgcaaggggacgcaaatacaaattcgatttgcgtaatcagcccgatcgtattgccgatcagggaacaatcgcctggtggaaacaacaaagcgaagaagcccgcacaatcctgaaaccgtcgccggaggatttggaactgtatgcaggacacagacaattcttcgaagacctgaaagcggacggtgtgagccgttggcaatcactcgattatgttcgtggtcctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttacttgatggttttgtgatgcataattcaattcacgattgcgcgaaagatgttttgatgatagtctatgcattgagatatgcgctggggctggaagaacccccaagtgaagaagaaaccgatccattgagtctgccgaggaaaagatgattaaattatcatttgtaggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgtaaaaccgttagtaatgcaagctatatccttccggggatggttctgaaattgcctcagttagtcgaattatgataaaaagcccttgcattcgtgcaggggctttgttattttgtagggactgaaacaaaagaggatgaaacatgtttggtgatttgaaagaaggtttgaacattttaatcggatttgcgatcattggtgtgattgcgtgtgtatccggtgcggtgtggttgtcttatcaggcgatcgtgtggttgggtgaatggcttcacattctggcacagtaaggggatattatgcgtttatgtttagttggtgtaggtttcggtcgtgcgttaactcaagggttaatcgactcaatccgctggattcagccaaatgttgaaatgtattcattacctaaccggatcgaatactctgatccaacaccgtacaaaatgaaaccttatcaagcgccacgcgttaaccgtgtgttacatcgtcaatctgtaaacaggggtaagtgatgaaagagcttacgatcgtcgcagcagttctgattttcatcatagtttcaatgattatcgtcagactgtaccagcacggggaagcgtttgaatggttcctggatcacgacaaagcgtttcgaaagcatttcgcgggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcaatgcaaggggcttttttgtatattgcgcacataccaaacggaggcaactatgacacgtattaacacaatcgatccttctcttcttctgaacgaacacctgattgcagaactgcgcgaactccctcgcattcccaatgccgttttatctggtaaggcaaaaatcaacctgtcgaaaatccctgcattgtatacgctgggaaccggacacgtaaccttcttttacaataagctgggataccttcgcgatcgtcatgctgcattacgtgctgaatacctcacgcgtaacggtaaagaatacatggacggtgcatacgaagatttcgatcttagtccgctgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagcggcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagtcctggttaagaacggtttcaacgaaaacgacgcggtagcaatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgatatcaagcacgaccctttgtttggtgttctcctgttcggtgatagtttcaacttggggagaacttttattgagcgggttattttcccgaaatggtatcaagggaaacgggtttagcaaatagcactttttgctaaagacttcacgggatagctttgatatagttatcccatcgaaacgaaacagactttaggagattgccatgtatacttttgacgaactgaacgccgcagcacagcctttactggatgcgatgttcaaagcccgtaacggtggcgcattcgaaaacgaattctttgaaactgttttcgttctggaaaaaggccgtaagtatcatcgtattgtgcaggatactcgcaacaaacagactggtgaaatgttcgatcagcgttcagttgctggtttcctggacaatgacggcaatatcctgaaagccgcaggatggaaagcacctgctaagggtattcgcggtaatatcttcaacaatccagagaacgcgatcgaccgtagcggttacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcgcaacacgaagcaatgttaaaacaacgtcgtgatatgggctttgtggagactgtgagttacacaaacgcctttggtgatgtcaccacgcgctctgtaaacgtcttagggcgcacgaaagggacaatgctcaccatcagacgggaaggaaccggaaagctcgtagacgtgtgtttccgcgcgattacggacgattccaaacgtagtcttttcgccccatacttttctacgcctgtctttgcaaaatttgacggcggagaaacaaaagagtttagcgcaagcagaggaagcaccgaagattttctgtgtattacttccccgcaacgcttccttttcaatatggatcgtgctagtgttatgcaagtccagttaacattcctggatcattactccaaagtgccggaagtacatgaatggaacctgtcaacatataatgaggttgtgaagaaatgagcagacgcccaaagaacagcaaaaccgaaatgtttgcaacgtttgatgtaaacggaaagaacattgagggtaaaccatgcacgaactcaaagtttatgcatatcgccggattgcctggtatgagtgttaagacttcgtatgattgtcattacaacgaagaaaccacctctgtttatttgggcgaagaactcatggctgaacgcgtcatgcagtgtgtgcatttccctggtgaacgtccagaagtgaactgttttattgttggttatcataaaggtattgtaaatgagcaagtataaagttggcgatatgtacgccccgaaatctattttaatggctgtgtgtcaaatggcatcagaagccgatccgattcgtcgtatgtatgacgcattgcgtaagaatccgatggacttcaattcaccacgccgtatcagtatggtgtatgaagaaacagggattctttatcttgaaggtattcccgttcctgtcaagttcaacgatatgaaagggcttttcaatccggtatgggttgcgccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgccctggatgtgatttacctgaaactgagtacaacccacgggacgacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaatttccgaaaatgtccagcatcgcaagccgcgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgtttgagcgatcgcgatcacattcgcaaacgtccgaacatgtacgtgggttcagtgaacaaagaagcccatgaacgttttatcatgggtaaattccgcaaagtggaatacgtggaagggttggtgaaaatcatcaacgaaatcctggataactccatcgacgaagcgatccgaactgatttcaaatttgcgaacaaaatcgaagtcaagattgatcacaatctggtcactatttcggataacgggcgcggcattccacaagatgacgtgagaacgccggaagggaagattgttcctaaacctgttgcagcatggacaatggctaaatccggttctaacttcgatgacgaaaaccgcgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctatcttcggtgtggatggtatcgacgaagagacaaaggaagtcatcaaagaccgccttatggcgcttgcagtggctttccctgccgttaaattcacatataacggcgatatcctcccgaacaaattcgcgatgtatggcgcgatgtatggcgataaaacgattacccagacaaacagcaaaatcagtttcatcctggcaagcacagaagacggtttcaaacagaaatcattcgttaacggtttggatacgaaaaacggcggtgttcacgttgacaccatgatcgacggcatctattccgaactggaaccgatgatcaagaaaacacacgctatcgagatcccgaaagcccgtgtaaaagaatgcttgactttggttgtgtttttgcataacttcaatgcaccagcttttgatagtcagacgaaagaaaaactgacgaacaccgctggagagttcaacaaccacgccggactgaactacaaaaagatcgcgaaacagattatggatacttctgaaataatcactccgatcattgagtccgctctgattcgcaaacaggccgcagaagccgcagccattaccaaagcgaagaagaaagctaaaaaggcgaaggttgcaaaacatgttccggcatcagggatcgacactgacggggtagaaaccactttgtttctgaccgagggcgattccgccgtggggcagtttatcgagtgcagaaacgaagagacacaaggcgcatttccgctacgtggtaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgctgacgttgacgggggcgatattctcaccctactgattgcgttctttagccgctggcctgagttgttcgagaagaaaaagatccgttatatccgcacaccgattatcattgcgaaagtcgggaaagatgaaaaatggttctactcccttgaagatttcgcaccgttccgcgataaggcgaaagaggtacgatatatcaaaggtctgggttctttacgtaaagaagattacgatcgtgtgttgggcgaccagttaaaatacgatacaatcgtactgggcgatgaacacaaagacgttcttgaactgtgtttcggtgatgattccgatccgcgtaaagactgggtgaacggaaaacataaattttcggtgaaataatggaaagaagtattaaagacgttgtacaggtggaggggcttacatttgccctctatacaatttattcccgtgcgatcccgcacctggtagacgggttcaaacccgttcaccgtttcttcattcattccgctgcaaaaggcggtacaggcttccagaaagtagcctctatcgctggcggtgttgcgatgtatggataccaccacggggaaacatccgttgaagaggctttgtctctcatggcggcgcactggtgcaataatatcccgcttttcgaacgtgatgggttctttggttcccgtctggttaagaagcctggcgcaccgcgttacattaaatgtaagctgtctccactgttcaaggctatctacatggacgaggatttaacgatcccacatgaagaccctgaacatgtaccgccagcctattacctgcctatcattccgatggtactggttaacgggttcagcgggatcgcgaaagcatacgctaccaacattccaccacacgatccggtttcggttctgaatgggtgcgttagctacctgaacgggaaagatttcacgcttgacctgaaatacccgcactttaaaggcgacatcaaagacgggacgatttacggcaagtatgaactccagggtaaaaccaaactggtgatcacagagattccggtcaagtacgatcgcgtgaaatatatctctattctggataagctggaagagaaagggtatatcgtaagctacaaggatctatcgaaagaagatttccgctacgagatcaccctcaaacgcgagtatgcaaacgggcttacccctgagaagatcctgaaagatttcggattgattgagaactcaaacccgaacatcaatgttatctttaacgggaaactgcattcatacgagcgccccgaaacgttgctgaaagacttcgttgatatccgtattggtgtttaccaacagcgtattgataaacgcatccaggagactaaggaagcgttagataaggcgctggcgaaggttgacttcatcgaccagatgatcgcacaacctgacgcattaaaggggcttagtcgcagcgaagcggttaaacttgtctctacgtggacgggttgcgggaaccacgccgaaatcctggttgcgatgaacatctatcatctaaccacggatgaacgtcaaaagctggaagacgaagcgaacgaactgcgtaagcaactgaaatactgggaagaaacaaccccgaaaactgaatatctcaatgatttgaaagaactttcgaagaaattgaaataatttacaaaaagcctcttgcgttgcgggaggcttttttgttatagtgtcctcactgatttggggaggatataaaaatgttcaaaactcgtagcgacatggaaataaccatttgggccaaaagcatcatggcgaagcatggtttatctcattggtctttcaaaattaacggacgtttcaagcgtactctgggacaatgcagctacggtcgcaagttgatcgagttgagccgttctcacgttaaggaagatatctacgaaaacgttttagatactctcatgcacgaaattgctcatgctctgaccgaaggggctggacacgggatcgtttggcaacgcaaagctatcgagttgggcgcacagcctacaccatgcaaaagccgtatccgtgagaaatcagtaattcaggaaagcgaaaaagacgtatacgcatttttcctgaaaactccgaacggtgaagtttatcagtgcaatatgacagaaaagatgtacaatgagatccaggaaggtaaacgcaacattgcaaacatctatatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcattgatatgaaagaccgcgaacgtcagaagcaacaggtttacgaataccttaacaggatgtgcaaacctattgaatacgggcttgatcaaaagcctgtgaaatattcttgtgacgacataatctttaacaccaagtgagatataaacaatgaaattacgtcagttagcaccgcaaaccattcacactacgggcttcgataaaggcgaacgcacgaagtttaaaatggctaccagtgcgaaaacgttcaaaatcctgtcatcaaccatctacaaatacaagatccgcgcaatcattcgcgagatctcctgtaacgccattgatggtcacatggtagcgggtaacatgaatccgttcgatgttcagttaccaactgttctcgatccgcgtttcatcgtccgtgattatggcacggggttaagtgactggatggttaaagaggtgtttaccacctacttcgaatcaaccaaaaccgacaccgacgaactgatcggggcgctgggactgggtagtaaatccccgttctgctacaccgaaacattcactatcgaatccatccaggacggcgttaaacgcgcgtacacggcttacatggataatggtgaacctttcgttgaccaaatctacgaaatcgaaacagacgaacctaacggcgttcaaatcactgttcctgtgaaagtcgaagatatcgcagagtgggaacgtgaagcagcgcgtgtttacgaaccattcacgggtatccgtccgcgctttatcggtgttcaggttgatgtcaactggcaaccaaaagaagcagacgaacgcgggatcatccgttataagtccatcaactattccggcgtatacgcgcgtatgggtaacatttgctacccaatcgacatggatatgttcgaaaactcgctgttctattgctaccgtaacagcaattacgcttatattctggatttccctctgggatcgctggacttcatgccgtcgcgtgaagagttgagccttgataaagtcaccaaaaaagtaatcctggatcgactggaaaagatcaacaaacgctatgacgaagaattagttgcagagttcgacagacaaaaaacaacccgcgataaactcgtatggttcaacaatctgcctagtttgttacagacatttgtaacccgcgataaccgtttccgtgtgggtaaaaactcactggctgaaatcctgacgcatatcaaaagtcctgagactgcaaccggaaaatacgtctggggcttttgggctaacccatatgacgggaaagaatgtgtatatgagcgcgttggatctggacgccgttatgagacatacaaagcggaaaccaccaaacgacaggacgttatgcgcattatccaaccgtggcgacagaagaaactgttcattgttgaaaacgacaatgaagcgcgttcactccgtccatacctgatcggttactgcatgttgcacggttcggatcgtatcagtttcgtaaccaaagagattaatagcgatcctgttcaggacttgatcagaactgggtatttcgacgaatccgaaattgtcacactgaaaaccagtgaattaaccaaagaatttgacgtgtacacggaagatcgcaagcgctggaaagcaacgcgtgaatcatcttctggtgattgtgaatcgcgcccgaaaacgcctacagcatatcattacttcctggatgatcggggcaacttacagaaaaatgatctgtacctgaccaaagcacagttcgtgaatctggatgaaatgtacgctatgcgcctgtacgggattgatgaatatagccgactggatggcgaagcaccgaactattctctgggtagcatcgccagcagtatgatgaccatgttaaaggtcacagggctgaaagatgtgatggttctgcgaaactctctgtggagtcgcattccagatagcaacatgaaatgtcttgatgattatctggtaaaacgttttgcagacgcagcgaagaagatgaaacctaactggttccctgcatggatttcatcaaaccacggaagcgagatccgaaccctgcgtgattctatgggtgtaacccttgatcgcatggttaaaaaccgttacaatccagaattgtatttgttgcttgattatcttgatggtaagttcacctacgatactatcgagggcaaaaacaaatcaaaaactgtggtgcgtaaccccttacttcgtgaaatgtcaacgaagtattacaaaatgcggaaagatatgaaagaacgcgttgatactgcttacgatttatttgcagaacgcaacccatcaattcattacatgttgttacattcatcttattctacattccgcagtatgtttaatgatgataaaattgtgatggatttggtcaaccttatacggtggaaataatgagaaacgttaagatccttgatgatgtacaaaagaaagcagtttatgagggctttctgaccagcgcaaacaaaaccgcactggctaaacaatttggtgtaagcgtccgaaccatcgggcgcgttattaccgaacagcattctaagtataatacggaagcatcgaaaccacttccgcaaacagatgtcaaatctaaaatgattggttctgaatcgttcattactctggtactggacggcaagatcatcacagcggattcgtcacaccctaacttcgaaaaagcacatgctttaatggttaagggtgacattgagggagttgctaccctgttggacacaacgcaagcgttgaagatttacagcaaaggcaacattaaaatcatcgggcataaagtcctgtacaaagatatcgtgtttgacagcggtatcacgcaacgtatcgttcgtgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataactcccctggtgttgtggttgaaatgccacgtaaccaggtagacgagaataaaaaccgaacctgttcatgtggtttgcatgttgccgcaaaatcgtacctgcctcactatggcggaggacgtgggcgagtcattcaggttaaggttaatcctcgcgatgttgtagcaatcccaacagattacgacaacgctaagatgcgcgtatgtcgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccatcaaaaccgctaaagaaatctggaacggaggcaacgttaccgctggacgtacagaagacggcgaacagacatatttcaaaaaaccttacggtattatcgcaacagcccttgcatttaatctgggttatgttatgctggtaatcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattcggaaataaactggtaaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtattccgattctacgtagccccaaatcaacgccgtaagactggcgcaaaccgtactctgttacgtatcaaacgccgcgaacacgaaccatcagcgatggtggccttgctggatagtgcttctctgtacttcgttgcacacgataagattaaaaacctctttggtttctcaaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagatgaaatcgtagcaacttttgacaaaaccctgaccgaactggaagcgcgtattgctcacgataacgaacaggtcgcacaggtagcagcagaccgcaaagcagcggaagaagaacatcagcgcaagctggctgaactggctaccaaagaaagtgatcataccgcaagcgcaacacgcgccggacgtatcgcggataaaatccgcaaactgctggattaattctctaaaatggggctgaaaagccccaataaggaaaataatatatgtttgtaatttcttcgtactatgattcacgtcaacgagtatcgctgtcttctatttccaaagcaccaaaagatatagatgacttcggattgcttaacttcgtcaagaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacactgggctgtatctcgttgaagccgacgaagatatcattgaaatcctcaaaaccgctcacggacattatgtgaacggatgcaacaataccccagaacaggatcacgctgtcaatatcgttaacctcatgttagggccgcgtacagatgacaacctgaaatgggcgagcgaatccaacgttcctcatgagtatgtcggaatgtattatcagtgcaacgttgacgataaagcgccactgataccggaaaaacagatcgatttagtagttcgaacaggtttcttcttatgagttcacaaattctgttcagcaaagaagatccattaggcacagattcatcggtgcaacgcttattctggcagatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaagcccttgacttcggttgagggcttttgttatattggctttgtcgaaacgaaaccactaaggagattcaccatgactaacctgactaaagttaccgcgacatacttcatttcttctggcgctaaaaatgctatgtacaccctgcgtgtagagcgtcgtggaggtgaatttacttctgataactatatctgcaacctgtctactgacccagataaagcggaagcgaaagcgcgtgaatacttcgatcgcatggtggatcgtcttaaccagaccgatactttccagatggtgttccagggcttcgcagatttcgatctgttcgaacgtcgcggtaaactgtctgtacaggataccgaaaatctggaactgttggagaagggcatcatgccaatcggcaagcgtaaaggtgaagtgattgctgatatgccgatgtatactattctgtggtgggctgatcagtgcaaagaaaacggcaacgatagcccagtatttcaggctatttgctcttactgcatgggcgtagcgctggagaaggattatatcgctaaacgtgaagagatccgcgcagaatgggaagcagagcgccaggcgaagatcgcagcagcgcagcacatcggggaaatcggtaagcgtatggaaatgagcggtgttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacccaaacttcacaacgaatacaaagaagttaaacaaacaatcgttcagcgagtaaaggtattagaatgacgtatgaagaaatgttaaacgaagtgtgcgcgggtaaaaccgcgtaccgcccaattaacccagatatgatcgtgttccgcgaaggggatacgatcattcgacgttctcaccgcaaggttgagattaaccaggtattcattgccagtgttgaagaacagaaagcgaccgactgggatatagttgcagaagatgataaccacgacgaacttgacctgatcttagtcatagataatcacccactgggtgttcgtccgtacatttaccacaatcaattcagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaaacccgatgacgaaagtaaaagatttcatcaatcgggctttgagtagtttgaaactgaaattatcatcgaatcctgcctaaaattcttgcggcctgattgcacacggtcatcaacttcgtatcggtgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatatccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagtgccatgtttaaacctcaagttcgggggatgccgaccccgaacatatttaggaatttacttaacgttgagtaaccaaaccagaacggttttgacctacacgggcgtttagatagtcataccatctggtcgcctgagaagaaacaacctgatattgacgatatccatcatgtatacgtccgttgttgtcaaaatcgaatacacctccgtcatccatagtaagccgtaagttaacagcaggaccgttttgaatagtgattacactgatatcagggcttgattgtgcagcaactacagtaccgaacgcattaccattaaaactaccaccgaccgcaggataaccagaaggttttgaatatggcgagtaccaaccaaccccccactgaccacgatatcgggcgttgttatagtaacgctcatacactgtaaagttgatgttataaacggactgattcgccatttgtgacatccagaagggtaaaccgattcgaacggcattaccagcagcagacatcaatcgttgtcctgtttcaccgaccgcagacgaaccgatccacccaggaactcctacaatagccataattttacctctttaaagaggggcattacgcccctattttccgttcgattgcttccaaacgttcacgcaattcattgattgccgtaatcagaagcgcgttaacacttgacggggagatcgtcaacattccggtttcttcgttttctcttactgcttccggtaaaaccttttgcagatcctgagcaataatacccgcttcacgaccattaggttcatcatcttcgactttcagtttcttatcgtagatataacctttaagctgttcgactttactcagtgcatctttcagttcaactaggttagatttcagcctgatatcagaacgaatatacacatcgttaaaatcaccatgtgcccctgagtaaatataaccactggctttgaattgaccaccattgtcgaaggaaaaatcagcaccaccaacgtgcataactacaactggattgccgccacccgcatggacatccattgcggcaatatgctgatcgccccagtgtgtagctttccagatgctgtatgcttggtttctggagttaggacaatccaccaacaacccagcagcacggtcacgccattcgacccacgcaccaccctgaacagtaccacgaagtaaacctttatcgccaccagtggttagcgcacctgtagtttgaatcatgccgtcaccaaaacgagttgaatattgctgactcgtagtacggattttcaacccgccatcaggttccgcatatataactgccttttcaacagtaccagcattgtttctaaaccataagtgactgtttccgtctgagtttatgctcacaccgtcgccaccacgaacagatatattattctgtgcgtatgtcatgccattaacgtaagcatcaccagaaaacgcaatttcaaccaagttatctgatctacgctgtgtataaaaatgatacccagtaccgtcatgtacctcaaaaaccgcagcacgaagaccactatcaccccagtttctaatagtaaatgcacgttgactaacagcagttgatgcagagttaccaagagttaacgtagtattatctaaccgaaacgccgcgtttggtgtagaaacagcaatatcacctaatcggttatacaggttaacggttgcctgattacttgacccatatccgaaataagagttcaatacactcgtatctctgttccatatctggaacattgctgattctgttgcaggtttataacggatcttgaatccatcattaccagcatcagcagtgaacgtaccaccgtaaattgcgccacctcgacctaagccattaccatcaataaaaaattccatagaactatcggtagcacctgacatcagtcggtattgagttccctgtatagtttcatgccatatcatatcagggagaccaccacggaaacgacgtagtaagtttttaccgccagccgcaccagttgacagcatttcaattttgggcaatgccggatcaacaccattcatatacagcggagttgaagaagatattccacctttcacatcgatgaatatcgtaccagcaccacggaaatagtgataaaattttccgtcatcagctttcacgccaagatgcgttgcgccgtcaccagaagcattaccatccgaacttgtatcaagtcggatcaagctgttgtttgctggcaatccagcaccattaacaaaaatttgacgtggtgcggtcaaaccgtttgccagaataagagtaccatcagcagcgaaacgtgttacataagaaccacctgaacgaacatataagtttttaccagtatcagcaaatatcatcgctaattcgttaccgccagcatcacggaattcgacgttacggtttccgtcgccttttgtgatcagttgggttcctgttaagttaccactgaccgttgtactcataccaacgtttaacgaagcaccggaaaggttaattgaaccatcccagccattaagcccaatctgagcgcgtagaattcccgtagcgcctgttgtcttgtttggtgcatcatatgcttgcagttcgatagaacccgccccagtagttgactgatgcgataatagagcagcaaggttagcaccaccaaaaggatcggaagtattcgattttgtgttgacaaacaaagtaaacgtgcgcgtatgctgtgacgggaacggatctgtaaccgcgttgttatctgaacgagtagttaacagataaggagcattccccgcagtatcagcaactatgttaatacgacgaggaaccgttaactgggtgttgttctttaatgtcagatcacccgtcatttcgtcgccagatttcttaacctgtgcatcgttggttacgttgcctaatccgatttcggcttttgtcggtttgtcgttttcggtatagactttaaagcctttatacgttaatgtgtttccagttgggagtaaaggcaaattagcctgactccatatagtattaccgccgatggtagtacccgattttaaatctgccattattagatcctcaaatgcttttatgatatttataaaaagaaaaagccccgaagggcttttcttattttcgggctttgagttccctgatttcctcacggagttctttgatcgcattaaccagcaaagcgacaacagcagaagacgaaacccccaggatttcatttccttttgtatcttcacttgtggtaactgcttccggtaatactttttgcagttgttgcgcaaccaagccagcttcacgggtagtaggttcaccgccgatatattccgctttatcgtagatcataccttccaacagatcgactttatccaatgcagattcgatcttactgaaattacttttcagtctttcatcagaacgaatatacacatcgttaaagttaccattaccagacacggttacttgaccatttgcatcgaaatatacgtattggttactttggtgaatcaatcgaacacgggattgcgtaggatcgttatttggaatatgcacgtccatagcagcaacatgggtagcttgccatacagtagctttccagatgttatatgctgaggtagcaccgttaggcatatcgatctgcaacccagatgaacgctcacgccactgatcccatccaccaccatcaggtgttcctcgaatcaatgcaaaatcagtaccagtacaagggtcaccgctatagatcataccgcctcggaaatcccaagtggtttgacgaacgttatttgttcgaatgtggtattgtccgttagcatcaccccaagttgccgccttttcagcgccgttaagcaaacgataccaaataacactattaccgccagcatccagatatatgttagacgaaccaccctgagcaccgtttagcgttaagccgccagcactactaagagtgaaaagttcagcagagtctgtttgacctgttgctaaacgatacgcgccgccctgaacagtttcgtgccagatctggtcgccattgccaccacggaatcgacgaagataattcttcgaaccagttgcggttgtgcttaatgcagaagaacaataaacgttctgattcaatgcatcctgattaatcataccaccgccaggaagcgtaaagttaccatcttcaccgaatacgaattcacctgaatatgatgtatttccgttagctttgtttggtgtataacagctaatacggataccctggcgacgagaagtattacttactccatctttaaagataaaaccgtctatttctgtactaccatcatttttggcatattgaaatatgatatgacgattagtttcatttttgaaaatcacgtcactaaccgtattgagtgcgccagtcatggtatcgccagctttattcaccgcccccacttctgccggagttggtggagtagacgtgtcgtaaatccgtcgccaaccgttagcatcaccagcactgaacgaccacgcaccaggtgaacccgtaccgcttcgaatccatgatgaattcgcatcgtaatacatttgcaccagagatacacctgtattcaatgtacggcggaagttcgacatttgaccgtaatatgtggtgttgccataaggcccgtcgatcgcgttaccacctactgacagaacatcgttcttttcggttacaacagcagcaccgaaactgtttccttgcataccgcgcggaataccagtgatataacgttcatcatggttagaccagtttgtaggcgttactgtattcgcagttaatgccccgcttacacttaacgtggttgcgctaaccgcagcaaaggtcgaagaacccaccacacggaaagaaccttgttcaacggatacctgttgagtttgagagtcaacaacaaaggaagtatttggtgtgccgtttttgtatgcattcagatagatcctgttgccgccgtcagcacgggcgttaatattcagagttgccagagcaacaccagaaccattaagcccagtgatttgcataatgccctgttcggttgacggagttccggtcacgtcagaacgtttaaacaatatacccggagccgccccgcctgtggtgatatcaacaaaacttttcgaatataatgcgtttgccgttaagttaatacctacggtcacactttggttgaacgtggtgttcttcgcaacagtcccgccgttaatcgtcgagagggcgtttatatcctccgctgttgggcgatcgttctcagtgtatactctccaccctttatacgtcaatctgtcgccagagggcagcagagggaggtttgacgcactccagatacccgcaccacccagcgttgtacctaatttcaaatcagccataaaaatttctcctgtaatgactgtatttatgaaaaaggggctttcgcccctttatctaacgattgacagtttaacgtctttagcggataccgtaccgatgtttgtgttgtttggataacgatataaaccgaaatcaaacgtaacagcaccagaaggaataaccccttcgtttttgtagaatgaatatacgttcgggatcgtaccaacatcacgcatgttgatccctgtgatatacgtattattcgcgtcccagaactgcattacgatatatgcgcctttattgttggcgattgcgttcgcatcgcgtttcatttggcattgcatacggatcgtatcaccagctttcaatccataactgcttagtgatgctttcgttaccgccgcttgctgggtagcagtccattctttgaactgatactccgctgtgtttgttgaagtatattcaaccggatcagaaacaatataatcaagttcagcaaagttatgcgaaatgattttcttgtcacttgcaacaccagtaggcgaaacaggcagagaaagcaatttatcaatcgggttttcgtttccgcttgcgtccacttcggaaagtgtctgcattcgaacaccgttcacaccaaccgcagcaccattacggtttatttcttcgcgcggtactttcgtgatctgtacgttgcgacattgcgccagcccgactttaacggttgacgggtaatgatatacctgtgaacccattcgagcgtttaccggatcggtcgggatagtgaaatatcctgataacgaatgccactgatcaggggctaatccggttgttcgaagaatagatgatacgatccattgtccgctaccgttttcagtccacatatacaggtgaacttctccccctgcatcacggagttctttagaacaatacagatccccagtgaatttgaagatatcgcccaggtaaacatcgttaccgatagaccataatccatatgaatggaagccatacagatccccgctgttctggtatgtctggacatcatcaaccattcgttcaggaatacccgttaccccaatatcactaaattcatcaaacacaacttcaacaaaactcgttgtgttgtctttcaagctaccagcaccaccgacaaagttttccatgcaaatctttttcatcgtcgatgaatagatagctgaataggatgaacggtgagaatagttggttgtggtgatcgggatattaaagaaccgagtttcgggccacgcaacagaaccaattttcctcattgttgctaaaaagttgtcgtcacttttgatcgcatcgaaagtataaaaacacacaattctgttcgctggaagtgaattcaggtagtctttaatcgcattcccgttcgtagcaggatcaccatacatatcgaatgctttgtaatccaataatgctaaagttgttccatcaatgacagccaggttaattccgcgagcagcttgtgttcgtctgtttataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgttggatttgcgaagattttcacgttaccgattttgatgtaatcacgtacaaccagagtatctacagttgaacccgctaccgctaccgccccaatttctgccggagttggttttcgacctgcatgatagatcaggtttccgttgatcatcgctttgttgtaatcggtgatattgatgttgaattcagtcaataccttatcgtcaatgccagttaagcgcatcttctggacgttaccagagaaatcacctgcctgaacatgtgccgtaccgctcacactggtaaagcgtccacccgtgccgtttacgctaactgacagcgcaccagtcatagtatcacccgttgcgttgacataggtactgtcaagatgctgggtaaagtttcgggtgttgatcacggttgcagtggttgtcccgttatcgttactgattgttacaccgttccaaccgttagttgcagcggttcgtaattgtaccgtaggagtcgcatcacttgcaacaaacagatcaccagcagtgttgatgttagccagggctttaccattcaggcgaatgttcgtaccgtagtacgccagagcaccgttactgatatcacctacagtcagaacgtcaaccagatccgttgtacctgttgccagtcgatacacgcttgcctgaacagtttcatgccaggtagtatccgtcacaccgccacggaaggtacgaagcaagtttttagttccagcggttgccgtactcaaaacagtattagcataaaccgtgtttgctttcgcagactggttaatgttattgttcgtggttacggtgttattaacagttaccgcagcgttagccgtcagagtcccgttagtggttacgttaccaacgaagttgcttgtaccgttgaacgtgttgttgcctgttacggtttgatccgcgtcacgacgcatccagcttgcagctaccacaccgcccagactcaagctattctgtgctgttgccattttcggtaagaagttttgcagagcaaagttcagaccgcgaggcgatacagcgtagaaatcttccagatagctatctacaggctgagtagaaccaaccagattatcaccgatgaatgtattcgatttggtagtgatgaacaccgcaccacggcgcaatgttgtagcaccccaagccggatcagtaccgttcaagaactgcatggtagccggagtaattgccaggttagtagcagtacccgcagcagcttcactgttggttgcacaacgaataataccttcggcggtatccgtcgctttcttcgcttgcagtttcttcgcagtgacaatcacatcatcacgcgtacccgcatcagtttcgccctgagtcgctacgcgtaaagtaccacgttgcgtttcggtagcagaaacaatccccaggttaatcgttgtccagatagtgccggactgagttaaaccgtcatcggtagcaaccgcaacatgatttgtaacgtcgaagaactctttcagcttaaccggaacaaccgccttattcgttaccgtacctgctgcaacttccgcagtggtagcgagggcaataataccatcaagtgattcagtcgctttacgatcgttcagcttcttaggcgttaccgcacggagatcatcggttcccgtgttcgtttctgtctgggttgcgatctcaatcaaaccgatgcgcgattcagtagacgttttacgatgcagcatttcaggagttactacgatcggcattgaagcagatcccgcagcagcaccagttaccacttcgttttcagtcgccagaacaaccagaccttttgacttttcggtcgccgtcttctcgttcaatgatttcggggtgacaaggtcaacaccgttattgaagttgtagacgttcgtaccagcatccccacgtaaagccccctccgctgtcgtagcgcccgttgtaacgagtttcccgatacctgctagggtttcggtcgcgcggcgtgtgtcgagctttttaggcgtgattgcggtagtgtcatcagtaccagcgtttgtttctgcctgagttgcgatttccagcaccccacgacgatcttctgttgctgatcgttcgttcagctttttaggcgtcacgatcacgtcatcgaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgttgctttcagatatgacagttccatatatggaagatagtcagtatcggcgttgaaagtcagagtgtcaacactgaaccagtcatcaggcggataatccttacgctgtgggaactgcatcatgtttttgttggtgcggatcttttcaccggaaccatctttaactttgatcgtacagttctgcgttttccccatcatgtacatactgatatacacgcgatcaccttcggcaacatcttgcggaagagtcagcgttacgttacgtacaactggaggactgccagcaacaggagtgatgaacacgtaatcgttcggcaacatgttcaggtcatcactgatacgacgcagacgaacgcgctgatcaccgtcataaacaacccaacggttattagcctgatcgaacatgaaaataccataaccggaacgctgtgaagtcacagaggttacgttgttgataccgtcatagctgatcgtgtgtccgctaccaggataaacttgcagagtcgcaacgttcaccgaagcaaggcgatccagatcgtaagttgtgattgagtcaccatcgtttgcgtaacgaggcaactgcaacgtaattttacccgtcccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgggtgtttgaacgcactaacaggttgttaacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttattgtgtcggatatcagaacgagcgcataactgaaaggctggttcgtaatatttactgacaacataagcatcaactaattcttcctcttcgagtccagaggacaccgcaaccgctcgcaacatttgacgaagccagggtaacgggttgtaactgaataatgccaccacgttagtatagctcgaatagaagttcaatccgtgcgagttatacgggatttcttgcccctcgctaaacttcgatctgtatgtgttggtgcaatagatgaactgttcgccccctagaagcgcctccacgcgttttttaatctgggtgtatactgtcgtcccagattgagagagatcacccgtataacgcgaataatccccctctgcgagcacatgtattttaatgcgcttcgtgtttttatattgcttaaagtcaaccagcgtttgaagcggtgaatctttgaactccacatcatgaaacgtttgtaggatcttccctgtaatcgtatctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtatagagaaaaatccttatacaaatcaaagtcatcaatgtttttcagtgctgcatgagtgatgaaaatcacatcgtaatcattgactacttcacgcagcgcatcgttattggttcttttggttcggtgatccgtgtccacaatcaccgctcgtttcccttttacctggttgatgtagtagtcataagactgttttgataacatcatggaaatcgaagcgatgattgctttttcgcccgtttgattgatatggttcagaatcgcctttgttttaccacttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtattatcgcgttcaacgaatttctccatgtattccatcgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccaccgaaaacatgttgcaaggcgaaacgaagcattgcatcagatttacgtactggtatcggtgcgatgctcaacgtttccaggttagccccgaatgatggatcgatgcggagatcacgcagaggattttcctgtacagggcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcaaactcaccgatcgaggtgcgatcaatcgtcacgtaacctttttcacggatgatgtttgcgatacctgttttccaggttttctctgcaaagatttcaggggatacggttaaaccgtaagtttttccagcgaataattccatgattacctcaaataaaaaaggggatgccgtaagcacccccgaattatattacttacttgccagcaatgcaagttttgcggcggcttcacgaactgcgcgagctttctgcgcaacaacttcgatcgctttctggtgttctgccagcgcgtcttctactgccagcgcagcctcgatgatctctttattgcgttgctgtgcagcaacatcaacggcctgaactgctggagcatttgccggagctttaccagtaccgagttcacggaagaatttacgctcacgatgcatgatatacgggagagtacgatcttgtgtgatagatgcatcaccgtcgccgtcaacagactcaagcaccataataccgttgttatttttgatgtgttgcacaatgcgtttgttcgcggtatgagagcgcaggaaaccagcttcatctaccagaacatacggacgaccagcaacgaaatgtgtaggcatagcttcaaccgttgctggctgtggtgcagcaggttttgcaactggttcagttaccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgcgatgtttacaacaccgttcagcaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagtgggatcgaccacttccagcaatagtcacgggcttctttacgggttttgaaattcagaatcatgatattatctctcatagagggcttgcaatttagtaacaaattcatctttgctacgggctttgattacaacttccagacgagatttggcttctgcttttgcagcgcccaaactccaaccatacacatcaaccagttcacagatttctttgatgattgcgtttttcattttctcgtcctcaagtttgtttcgatgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagtttagagcgttctgtatcactctgtaaggcttcgagggtgtaacccgtccaaacccacacatctttatcagggaacgtcgcacggacgcgctggagcagttttaagagcgttggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacaaacaacactacacggattcctttaccgttaaccacatccatgttatagatgcggtcaaagttcatcagcctttcgcctctgggaacaaacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcgttgttgattgcttccagcttgattgaatccagcaggtcggcgcactgttttttaacgtttgtcgtgatcaattctttgatctggcgaataccgcctgaattgatatcgaaaatgtcgctgtatgcatagcgtttctgaatgtaatcagcgaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgggtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatattgttatgcgcagactctacaacctgggatactgaatccagcggattgctaccagacacccagcggagcagatgacgatcatcaccgttaatcggatcaacgaattcaaatctgataccgttttcaatcagttcgtgcagaagaaagtttatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttgcccggagaactataccgagaaacgttgattgaaggaatacgaatatcttcaacgatatcgcacgacgcaacagcttcaacgaaatcgagaattctggtcgctttgatgacgtgcgccttaaacgaaccgacttctaactcatattcatctttccagcctgaatagtagtcaacagcagggctaatcgctttcatgagcgcttcgggaatgtcaatgtgccatagctgttctgcgtactgtttgcgccagtctggatacgttttacgtgctggtttaaatgcactgttgccgtcttcgaacatcatttctttcctctctttttcgtaaatgtcgtacacacttcttcgttcgtaagcgtcttttaggttgctgtttactatactatcatgcgtcagttcttcgcaatactttttatcccattcagaacacgcatgatcaaccatttcctgaaaaactcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgcaagccctgccagatgttacggtgttgcagcgccagaacataatgactgttggacacttcctgccccgccgccagcagttttttgatctcagactctttaccactgtgaaggtctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgattggtgaaccattcaggggctttaacaactttcccctctctgatataaccgattttacacagttcgttggtcaagtcaagtctttttccacccgccatataaaattttaatctgcttactgggatcaccggacggataacgtcgcgatagccgaaatgcgcactacgcaccactatagagagcatacgcaaacggttgatacatccggtatacgaacgaccagtagcgcgggagaagtcctccagcgtaacacctggggcaatagcacctatcagatcaagataatccttttcaacccagaaccgcccgacagaacatttcgatacaccctcagccatttttgcgtttgggtgtttctcgtcttcgcgcttcttcttgtcctcaaggaacttattgaaccgaatttcttcgagtcggttttcccgttctacccgcgcacgtacacgggagggaaacagagtatcaaggattttcccgatcatatcgttggctttccgtttggtagtttcagatcgaaaggaacattcacaggccggacggtttctaattggagatattgttccatccccacacgcttaccacctactttgttataacggatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcaccagacaaacgctgtagattggcggttgcagtatcgtaacgcttttcggtgtctttcagggtagtttcccgcgccttacgcaagaatttttccagatcaccaggtttcgtcaccagcttaccatctacgtaaattcgtcccagcaggtgagaacaatccagcagttgttgtgcgtcggctttttcaacagcaggtttaagcgcgacaaactttttaaagaatccgcgatcctcgttatcaaacagatacgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcattttcaatacctcatagtttcggtatgtgtaatataacaaaagcccctcactttcgcaaggggctttttgattaattttgatgcttagttcggtgcatcatttctttgttcttaccttcgttgaaaccacggacagcaggagcacccaaataaccgcatgtacggcgcgtgacgctcattttaaccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttccagggcttgcaggttgtttttcatatcagggaattcaacataactgatatgaccagcagtagcgatgtaatgataatcggcttcatagtcgattttctcgaacggtgttaccttgcggtcaacgtccagatggaaactgtttgtgtaccagcctttatccgtgacacctttgacgcttccgaacttctcaaagtccagcttacagaagcgatggcagagagattccgcaggggttgaatacaggctgaaaccatatcctgttttcttcttccatgcttcggttgcagcgcggaggtactcaatgatcaatcgacctaatttctgggagccgatgcgatcaaatgggtgttggcctgagccaaacatcaacagcgtttcatgcagtccgatataacccagactgatagagctacgcccatttttgaacagttccagaatttcatcatccggtttcagtcggacaccaaaagcaccttctgtgtataggatcggcgcaacactggctttaacaccgcgtaggctttcgatacgagtcatcagggcttcaaaacacagttccagacgttcatcaaggatgcgccagaatgcgtcgtgtgcgtcttcgttttcctgtgcttccgcttcaatagcgatgcgtgggaggttgattgtcaccacacccaggttattacgtccatccagaacttcattaccgttatcatcatgccacacgctaaggaaactgcgacaacccataggagatacaggaacgctagaaccagtaatagcgcggttattagccgaactaatgatatctgggtacatgcgtttagaagcacattccagagccagttgtttgatgtcatagttgcgatcctctggatcaaggttgattcctttttccatgaacataaccagtttagggaataccggagtgataccctctttacccaggccgcgaatacggtttttcagaatcgctttctggatcattcgttcaaacatacccgtaccagtaccgaaagtgatggtaacgaatggggtttgaccattggcagtatgtagggtgttaacttcatattcgtaagactggaacgcatcaaaaacatctttttcagtcttttccatcgcgtatgtacgatcgccagaaataccgtatttccttgcggttttttcgtgtttttcatacgtcatacgagcgtatggagccagcactttatcaacattcgcaaaggttgtcccgccgtactggtgagaagcaatctgtgcggtgatctgcgccatgagagcggtagcaacaccgatcgatttaggcggttcaatgtccgcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcgcgctgtgtcgggaatacccttgcgtctttgttcgcgttctcgttggtgatctctttgttggacaggttcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtcccgccagctttttctacagcaatacggattttttctttatcaaaatcaacggttttgccgtcgcgtttttctacacgcattacatttctccaaacttaccaaagagttcttgagatttgcgaattcttgcgttgatagcatcattcaaatcgtcatactctccgatataaattgattttccattgaattttattttcgcaacccatttgttgtatgtgttgcaccaatgtacgcctttatgtccagatttattatttctctgaacctttttcttcatgatgttttgttgttgtgtaatcttttgtaggttcaaaaatccatcaccaagttcaaccccatgaacatgatcaataacatacggtttttctggtagtgtaccatgaatcacataccatataatatgatgtcggaagaatttcttccctttgaaccctataacagtatacccgtttttatcaacaacaccagcagattgacctatacaaatttttcgatttgttggcttagtccatgtaacaacaccgctgcaaatgtctacacttacgcacttgagaagttcatcaagttccgtatatttttcattcatttagttgccttcattaattgctttctatattttgcggttaaggctttgcgttcgtctttgtcggcgtattcaaagcccatagaaaccatttcggcaatcatatcaggtttggtaagtcttgaaaaccattttaccttatctggtatgaatttgtcatgaatacggttttcggaataatcttgtttcagatatgcaagcaagttctctaaccactggatgtaatcaacatcacgggacaccagaccggatctgttgaatttgtgcttcacaataccttctgtaccgttgcataggttacacagtaggccgcgcacacgtccggcgttttcgccgtctaaagcatggtcatggtcaaggtgatgtttctcgatctctccctcaagaggacgtttgcagagagcacaacgcccaccttgtttttcaaagagggcttgcttgatagtcgggtagtcttttttggtaattcgtttcgtcagcataataacaccattcagtaaggtgtcattatttattacagggtgcggacgtactcgcgaagttggtcgaatccgcctacgtgtttcccgtcatggaaaatctgaggcatagtcatccggcgcgtaccaaccagggcttcgagttcgtcgatcaccgcttcattcagcacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgtagttcatccaggaaagcatataactcgcgttcgcgatcttcgttccagaacttgttatacactgcatcggtgatcaggtacggcggatcacagtacacgaaatcattttcacagatatcaatgtcacggaatgaaccactggaaaactcaatacctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagacccttcgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggtaatagcgactgtttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagagccagagaatatatcaagaaccaagtccccttcaaccgtccacgttttaatgtgatcttctgccagttgttcaggaaatattgctgggtgtttgaatgcaatctcgtccttcgttgagtgatttcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgagcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaatgattttcgcctaatttctcaagcattgcaatagcacgatgttcatcttttttatctttcagcagataagcaattcgaacaacctcttttagtgtcgcgttgtccacctgttccaacttgaacccgtagcccaccaacttacaaaaaagccccttgcgagcgacaaggggctgattgttgtagaagactactgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtataaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatatccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcgtcgtcatcgtcgtagccaccccagctatcaatatattctgcttcactcatgttcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaagttggtatgaacacggcgcgaattgaaagaggtagcgatacgtgcagcttgcaggttacgttgggtatcaaacgtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaaccagtttacgcgcacgttctgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaactttttgattccaaagattgaacgttggaaccttatacaatctggcaagccttgcagcgatcgcagtaccacctttaacgcaaaaatctttctctaccgcccagaatagaacaaaatctgtaggtttgtccagattttcggttaatacctgcattgaattgcgagcatatcggcgctgtacccattcgttttggttgtcgaagtgtccagctacccttctcgcttcgtcagcggccttgtacgtgtcgtattctgtatagtcgatgatatccttgccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttgggttttcgaactgttccaggaaaggcccgtagttacgttcgatttcttccagcgcgtcctgtaccgtaagccccatcacgcgaccgaaatctttagcggtgagattcgcgctgtcaattttggacagaacgtttttcacgcggttttcagtcaggtagcaggtgaattcgttcagcttcactttgtctgtttctgacagttcagaaggagcattgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggcagtgtgcggatctcgtcaaacgtaccgtatgccagcagtggagccattttcaagccaacagcaacagcgtaattcgcaacaacgttatcagggaggaactgaccattgacgcggatatcaaatacgtagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgctacccacacgccaccagtcaaaccattcatgatcacaccgttgatgaatttaccttcataatggttagtcagagaagaatatttcacaaacataattaacccttgattttcagttgtttttcaatttgatacgcggctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcgcggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggtttacgctgttcttcacgatgtttgttgatatacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatatacaacatgaaatagtttcatatacaactaacctcattttcgtatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttcacgatggaaatagatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaatagccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggtgcgggttctggtaaagggttcaccctcgaaaagctgttaggtatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgcgggtatcgcagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcaatcgccagtttttcatagaaatctgtacgaaccagggacgatacagcagcttcatattctgcatctgtcatgttttgaggacgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaactatagaaccatgaccggaagagtcaacactcagagtcattgctgtaccagaaggatcaatggtaaacagatcagttgcagccagatccgcatcacctactttgaaatcagcaggagcggttttcggtgtaattgttacgacaggatcagcaggagtaaaatcactcagcttatacagataaccgttacgggattcgatgaaatcaacatcggtgtaatcaatatacgcttgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccccacaaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacggatagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaagggggctacgccccctttgaattttaatagaaaccgcgagcttcgttatccaggcgacggtctgcaatcatgtgcgcttccatttgacgagaaacataatcaggatcgcattccattcttgcttcttcgtagttgtcccaagtatcagcaacccattttgaaccattccaacgagcataaccgggttcagaaggaacaggataattagcttcggcagcgtgacgcagagcttcaccaacagtatagtaaggagcatttgaattgactactttcttcactttaccatcaacccaaacaaacagaactgggtagtaagcgtttttcatcatttcgtttttcattttgctttccttcttcactgcgagagccattcccccgccttcgagtacaaatatactttaaacgagggtatgtgtcaacaagttttttagcaaaaagtgctaaaacttaaatgtttcgaatcggctatttctggtttcgcgaacacgaacttcaccatcacgcacgatatagaacgcaagtgatttgattgtgtcgattgcgcttgcatgtggacagctatcaggatctttgtaccagtctggggtttgcttaatccagtcatagatccaccacggacaggtataatacccgttagaactcgcagagcgccccatcatgaagattgttgggctaaacccttccaaccataccagttcgcctttggactcgtcagaagcgcttacaggagcttctacgacatcaggtactaattggatttgatcggctacttccggtgcgacctctttaacgtactccataaaatccgcagaagcatcaataaccacatcaggaatgtttggggcttcgatgacaggttcacccatagtcacctcacctttgtatgcgacgatttccggttcaggggaatcaatcagcagttccggcttttcttcttcatccggtaaagcagcaaccagatcagccagcatgttatcaaaggatttctgtttgttcagcttaacagcaaacacgttcatagcataatcagctaacgcgcctttctgttcttttgcgtcgagggtacggaacccatcaaccttttcgtaatcaatgttcattggaatctccagtgtttattcaatatttagagcataaatacatatatactttgtacatagggtaatcatagtggatattgaagtcaaatttttaaacacaagccacgtacagattcaggcagaagcaaacattgtctatgaactgcgtgactatttcagcttccagcccccaggctatcagtatcaggccaaatacaaatatggcgggtggaacggttacatttacttgatggactacaacgggaaactcccgtatgggttagcctatctggtatccaaattcgcagaatcacgcgggtattcaatctgggttgatccaaagatccacgaaacagaggatatcacgcaagaagattttgataagtgggttaacgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaagacatcgcaaactatcgtttgttcccgaaatcggcaatgctgggtatccgttcaggtacagcgaaaaacagtaatgcactgatttacgtttctacctggcaatcagcagttaaaatgcctgccgaatggttccaacaattcatgtgcttgatggttgatgaatgccacctctcaacaggtatgagcatcaaaaagattatcgacacgatggatcaatgtatcttcaaactgggtttatccggttccctgaaagaagggaaaacgaacatgatgcaatacatcggtgcgttcggtaaagtctttaaaccagttgatacgcgtcgtttgatggatgatggtcaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaattgcagaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaattttgaagcatagttgatttttaacgcggtgtcgtcaccgctattctaaactgcgtaagctgattaatcagccagccatgccccacaaggggtactgtgacacattcgccgcaacatgcaatcgtatatttgcggggtagtcaatcgtagttcgtgccgttgcacactgttagcataaaggttccaggttgagaaaaaatcccaatcacgaatatatgttgcattccatataggccattaggtttatccgattatgaaaatgcatccatcggtaaacatgcccttgccctacaattatatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcatcattgacaaacgccgtgttacgggagttcatcggttgtttgcacacaacgcatttacaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatgatatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgacttagcttagatttaccagcaagggcagaccaatcatcacctttgatcaggcgatcagaatcactttcagcagtatacgggttcacagaaagaccgtaacgcatcagaatagcaactttcggttgcagtgatgccggatctacggatactttgattgaacctgcttcgtcagcttcggtatacggagcgaagaacagagagcctacgtgatccatatcacccagatcatatttgcagccagtcagcatataatcgaacgggctgtttgtgtctgtatagacataataaccgttgttcagcttacctgttgccagtgggtgttgttcgtcggtttcgtgcatccaaccagacgcagccagaatgcctacaacacgcgctgttgcgaggacataggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcgacgttgtaacgtttggaaacggtgatcagtgtttgaataatgtctttgttgacttcttcacttgccacggttcccaggatgtcttcgatcaccccatcagcttcgaactggttagcttccaaatcctgcatcagttcaaccgtcatttcggttttaaacttacgcgagcgtaccggaatattccagcgatccatctggaaggaggttgacgcgatatcttcactggtttcgtatttcgaagtgtcagcggcttcgctaaccaggcgaatcttgctttggaacacagctttcatgatcgcggtgtctttgtcagtatccagagtgttcagggtaataggtgcaatcacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgcagactgacgcatcaacttgtgaattgtgtagtgtttatcactcatttctatggttcctgaattagaggattatattgtgtatttatgcaacaaatttccaatcaggatacttgtcactttttagcctataatcgaggccagaacgggacatacccaactcaatagcagcatccgtcccacttttatatatgacaccatctatagacacagaacgacttattttagccttgtgtgcctctgagagcgtcgatccggttctgtcgaatgcagaacccttatacatcgctttgatagtctcagaacgcttcctgtttgattcttccgattgtcttttacctgtatgggcttttgacatacgttctcgcatttctggtgtctgcatagcttttgatgtattttcggaaatcagcttacgctgttcataactccatccaattagagccattggagcacctttaccaccaataccagcgttgtatgtatcaggtcggtttatgaattcaatattgacaatttctctttctttctcatacatttcttcgcgggtatcgaacacatggaggatttcttttgtaaaatgttccataccgtatttcttttgcgcttttttgatcgcaatacctgaacccatatacgaatcattgatatcttcggtcgaatgagcaccaatatagattttattgttcagtgtatttgttattttataaatgatatgtttcataatatagcctcgatgattttcactatttatataaacaaaaagggaacccgaaggttccctttaaaatcgttatttttcaataacttagaatcaaagtcccttcacccagaccttacggaagtatgcgtttttaccgcacatttctttgctgatcataccagaagtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgagaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcgcgaagatcctgcgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacactgccggaggtcacgttctggaagtacgcaataccagtttcctggaatacgtgcttaacgatagcgccggaagcgatagcagtaccggaagcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcaatcaggttaggaatcgcacggcgaaccataccgattacagcagggccaatgttggtgattgcaccgctggatttaccagaggcaatgttggttgcgtcgtaaccgtgatcacctgcaatttcagcttccgccaggaaaccgccgaaggattcaacgattttttcgtcgcgatatactggatcagtatcagcatccttttcctgagtttccagaattgctgcaaccagttgttttttggacttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttccgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacggcttctttgttttcagagagccattcctgcgcgatgtggtcgaagtatttattcgcatcttcgtacagtttattttcgatttcgccagctttttcggcaacctgggcttcaaccagttcatcggagagttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcggtttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccacaatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttgactttttcggcttgtaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgagttttgcggtcttttttacgttccacattaccgcgcgaatctacgtgtttaacaatgacttcatctaaactcaaaccctcgacaatggacatcatagccagggctaaatgaggttcattgtccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttctttgatcagcttcgcttgttcgtcaatgtcttcatcagacattcgaagaatctctttcatgatgtatttatgggatacatatttccctactacaccttcaacctgtgacattaacgttaggcgacgttccatgatctcaatatctttcacttctgcgtaatatgaatcttgctggaaaatgaaggagattttgctaacgttctcttcccattcttcctctgtgatgatttttttcgcgatcaggttagtttttaacggatcggaaagcacagggctgaactgaatttgcagtgtgcggataaacttactaaatttcagttcatcacgggtgatttcgccaccaccaccaatttgcatacccccatcatcgcgaggcatacggcttaatggcacacgcagtgattcatagagcttacggttaaaccatttgatatcatccatatcagagaagttagcaccgcctggaagcgtgtctacttcggtgatagctttaccgtcacgacgcatcaaccagtaatcttctgtcattgacaggttgttttgctggttcttaacagtacccgttttagcatcgtacacaacgcggtttttaagcccctgtgcaatgttatttacgtactgtgtcgctttggtgccacccatctgacctacgtcgatgtagaacacacggcgttcaggtgcgcgggtgatacggtagatgaccatcgcatcttccagtaaacgcaattggtttgctggcttgactgcgcggtgaagatatccgataatgttgttactacaatcttccagaccagaatgcgcatacacgatagcggagcgcgggattttaaccttctggttatgctgatagatttgcccgttgtatgtatagccagatttaggagcgctatacacgaaaaattcgcgataaccacggaatactttcacgccaccatcaagggtttcagtgatagattcgcggatcagttccatcgaacgcggatcaagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctgaatcgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttataacctttattcccaccagtccagcgcgaacgtaacctcaaaggttgacacttcgttgttgctgtcccagtccagggtaacttcgcctacgttagtagggaacagcccgtggatggtgtgatcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgactttatacggcttgcggccctaccagttcatcgaaatctgcgcctgtagacgttgctacgaagttcagagtgatgtagttgatagaacgaggcggtttcacgtagaccgttgctacaaactcgttacggtcgattacgtccggcgtgttgttcgtggtgtcacagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagaaacgctatcagtgtaaacacacaggccagcgatatcacctgccagcggaacccaacggttcacgtcattgtatttatcatactgatatttatagttaccatccaggaagccatagcttgaacttacgttcagattgttatcaacagcagcaccaccactgagtttatagccagtacgccattcaatcatgttatcaaccgcagttgccagcgggatattcaccagaagtgagcgcggaggcgacacaaacacggtacaatcctgacgttcatcaccgattgaaataacatgtttctgaacggtagacataatctctacggtttcgccagcacacgcaccagcaatcaacagaggcacatgcagagcttcgcgatcagcgaacatatcccaaccattcatcagttcatcagcgcctacagtatcgtttgaggacaaaccaccgccgaactccaggataccggagaagcctttaggccagttcagggaagtaccgtaaacgtactgagagccaccgttcgcgaaaaagtcatccatgaagatgttgacaccatagatatctttatcggtcttctcggttgacacgatgaaggattcctgtacaataccaccacgacgcacaacaaaagcgtactggttatcggtctgtggcccgtaggtcattacagaacgaccgctgttcttaacggaaaccccagaagggtagccggaaatcatagcgccagaatcgtaagcagctttggagataatctccacctgaacagttgaacccagttcaccaggatacagagccacaacagacggcaactgatatttctgggtaagagtctggaaagcggttccctgaattgtttcttttgcaatatccaggttcaacagagtgatcccagaatcgctttcgatgccgtcaatcgtaatcgacgcagaaacaccggaagactgagaaacaatttcggtagtccagccagtagaaatatctgggtaagtaccaatctgtttagcacgggcaacgattttttcgcttggaatgattaccgagaggatcttgccgttactgtcaactttggacactttacctttttcttctacaacaacgctgttgtattttactttaatagtatcgttcacagtgtagttagaaccctgtgatgcgatagttgttttgatctggttaaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccagttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcgtcgtgatatccttcttccgcagcccacgaaacgcctttttctgagaaagtacgaaattcgagtattgtctttttgttatttatgatcaatttatctttctcgaccaggtctttcagcgtcgaacatcccatagcttttgatcgcttagtctgtttcatacccagatcgttgtaactgtcacaaataacattctcatattccagttcggaaaacagagatttggcaactgaatgccctgtgctatttagctcaatgtaaatccatgcctcgttatacatattcagataacgtaacaggatgtccggcaaaataagatgcgacgttttgtttgagtgatacaccgcaacctgttcaaatggcatcgtcgtaatgtcgatgatgtgcattgcatggtaatcctgtccgcgcccttcggctggatcaagtaccgcaacgtatttatgcccctctactggacgtttatactgataaaagttcgtttcagtttcatcaatatctatccatgagagctttgacagtttccagccagcgatcagggttccactggtccccatgaattccgcgcagtgttcctgcaagaatgcctctttgctggagccagcgatcatcttcgcagaccacgaataaccgtcatcaaatacgccgttgtcgccgtctgtatacaatcgctctttaaccgatgtccagatcgcggtgtaaggcacgaagccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacgataccaggctgcaagaagtctggcagcagttcgatcgcttgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacggcatttcacccactccatcaacatttgctgagtccatttagtctggatatacgcgcgtttcaggttagggttgccattatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcattagttccgtaggggaaccaacaaatacggttgcattctcgatattcaaaccatcaccaccgcctttttcagcgcctggttttgtagtctcttccgtaatctcacgcatttctttgtgaatcttcatcaggccaatgtttgaaacgtttaactgattcatcaggcttgtgaatacctcgacgtggcgaggtgattcggagttcttcgcgttgtgtaatgcaatctgcgccatatccatgatcatctgattcatatggtgcgcagtcttacgcgcgagcgtataatcctcttccagatccggtttccggtctgctggatgtgattgaacgtcaaccagttcaagtttctcgtaaacaaccacatcctccccagactcaacgccgccagggagggaatcaatattcagcaattgctgtaaatctaatttttcatccattttcattccctcggcttaggaggttcatcaccagacgggatcggcttatcgtgcgagtacgtctgaatatattcttcgcccgtgtagtcctgcataggcagatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaaatgcggttgaaaatatggcaaaatctgttctgcgatttggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacatggttaaacaattgtcccataagaacaatgtagttacgcagcgaactattataccagtatccaaaaattttctaatccccctgctggacgcgtccagacttacagttatcaaagtgccagcgcttcgctgtattagcggcgcacattatcccacaatgggggcattgtaccttttctcgttttttgcctttgtgagcagcaacgagacttgctatatgttctggtgatagcttctttcctttatgaacagcaccaattctttttctgaattcgtcggtatggtttttcccgtaaaatgggttgtttttaccgtcatgtttgcctttcatctgttcttttttaacaatgcgcattgcttttcgcgcctttgtcttttcttcaagaatgaactgctgttcttgttcagataacgatgaatagcgtttgtgttcataggtgaacatcatgaagaacgcaagaatcattttaggatcattggtttttgctaatgtcctgtgggccatcaaatgcttcattatatcaagttctactaaattttctggttcgtgttcgaattcaggaaataaagaacgtggtaatatatgatgtttttctgtgtgttcagtttttggagaagcctttatgatatcaacatactcaacgtatagatcatgaggcaaccattctttaagttttgtgtatatcataaaatcctctttgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagaccgtcaagatttcgaatcggttcgagatccagttctgcatcaggttcgatatggattccttcatttcgctgcaattcaggagccagttcttcaccagtgtagatgaatttcgccaggttgattttacgctgaggacgatcaccgaactgatagaacggatcggcttctacccatgtaacttcaaaaaggctattatccatagggaaataaatcaaatcccccagaacaggaataccaccatcagtttgatgtgcgaacaaacgaggatttattaccagcgtcatttcatcgtttgagttcaaaccaaatttactaaagaaatctcgttgcccttcatagttggcatacgattcaatatacgcagcaattttccatgacttcgtaaatttagattctcggtcttctccaagaatcttatcaatattcacaaagtcgcgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattgttccccctacaccataatgatcggtactgcgtcagacatcgaaatcagttcatcgcgcagactttgcagtttggtttccgcttcctggatcagtcgcgtaccatcaggagcaacaccgccaggcaattgcattccctggaacttagccagaatttgtccgttgatctctttcaccagtgcggtagagtagtcttttacccaacggttgttatatgcagacgttccgcctgtaacagttgaaccctgtcccgctcgtacaccgcctacaaccgcgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcacctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaataccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattgttcgtaatcatatgatcctcaaaaggggcttgcgccccttgttaaaattatgctaccgtcacagtacattcagcagaggtaattttggttgagagtgcatcagtcacttcaactttatatactcccgcttctgctactgtagccaggcttgcgccagtttccccagtaacttcaaccgtatctttaaaccatttgtatgtatatggtgttttgccaccagtaacaacaacggctaaatccatattatcgcctgttgtgtaactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagatttaacgatagaagaaccagtttcaccagtcaatacagaaccgtctttatgccatacgtaagtgtacgggggtttaccaccgctaaacactacttccagagtcaatgggtcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttttggatcattacactcggtgaatcagtcccgatattttcggttcctttcttccactggtacacataaggcagtttaccacctgtaacggtaacagataaagaaatatcatcaccctcgatataatcgttacgaccgaccagattttgagtaaatgacaatggaactttcttcgcttcgtatttgttatccgcttcaacttctgtgatatacggaaccagagcatcagtaacatcctggtgagaggctttattctgttccagatcgtccagacgttgttcaacgttaccaccaccgccagcttcgagagcagcaacacgcgcagtcagatcggaaatcagtttataaatccctgtttctgatcctgtagtattaactccgatcgcagttttgttatcgcgagccgttttctgaataccatctttgaggaatggatcagaactggttgcgtcaccataaacagctttacccatcgcgatattagccgcaacgagtccagttgacgtattacccacaattgcggtaacatcaatcagtgcctggtggtcgtcgcgctgtgtgttttccacattcagcagacggcctttgatgcttgttggctgggagtcagtaccgatatcggtcataacctgtgccatttcaccgcgcagaccatcatcacttgtttcaccaacgatcatgttcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggtcccatttcgttacgcagatcggtaacttcatctgttaaatgacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgtagggacaccatcaacaaacgggatctttggtaacgggttaagttttgaaatcatggattaacccctttatcgtactcgaattacgtagttgaccgcaaggtttttcattcgcgtttcgtttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacctgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatgacgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccatattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcgcgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcagtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcacctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtcgcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgctacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccacgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcatacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagctgatcctgaacccctttgataccatcgccaacttgcggacggaatacaacaggacgatcaacagaaatgctaccgttactatttatgaaatagaacccttcgccgggtttacccgatggaagcacgaccgtaatcgggcctgttgaggtatccatatcatgcaatgaacccagttcgatcgggttgcctgaataataggttcgtggtagtttctggaaatatccggtcgcgtggagcagcattgtacccacaccatcattcgcagtcaataaacgcacatcaccaaacgcgttgtacatgttggtgatgatttcgttaagtttaacaccgccgtcatacagcgggtcaccagttgacgggttgccgatctgccccacgtcaattaattttttaccagtttgatatgccattatggttttccttagaattcgaaaataatactgacttcttcggtctgatcaggagaacgaataatcggttgacggttttccatgtagatcatttgccctgagtcaagttcaagctgttctttcgtgtaatactgccccgttgcttttacttctggatcggtcggttgcgcctttttcagtaacgggtttacaattacactaacctgacggaatccacggttgccaggtaaagatgcttgcgggaagaacagggaatccatgtacgcacggaatcgcattgagtgaaccttcattcggaacaccaaatcatacatatctggataccacttgatcacgttgtcataaccccagcgaaccggatcttcttcgagttcattcgggaacggaacaacgatatgttcatttgtacagcggttgataacaacatctggtggaattgtatacagatattcccagatatagccgtcgcccatgtcgataccgttcgcttccccgcgtggaggttcgatcgattcgtgggtcggtgtccaaatgccaccaatgcgcacacattcaactttacccgtgatactggagattgaacaagagccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcatcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgggctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgtacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacccgtgaagttagtcttttcagacttgacaacctgcccttcaaggaagttaccgatcacgttgtgcagcgttactgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgatccagatagctttgaggcgcaaagcgcgtaatcatatggcttaaatctgggtcaatcaaaccaggtgacagatccggttgatacggtttttcgcgttcctgctgaatcagatcggcaatcaataacgtattgtctggtttccagaaaatcgttaagttgtcgcgagcgcggtaactcagttcaaagaacccgatgatttctcctgaactcttatacagcaacacaccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaataattcaggatcgggaagtgtgcctggatatttgtagttcgctacggaaataaaaatctccgtgccgttcgttgacatattggtgtattcatgctggatataaaaacgttcttcctcggtgttcccatacaggcgcacaaaggttttcgtgttttcttgccattgatacacaccagcagcagcggacggaaccacgttagcgggttttgtaggatcttgcagagcggttttcacttcacccgttacgagtgcatagagaataccatccatcacatccattttcttgacaacgatcttatcatttccagggacaactgtatagctgtcagtatcgaaaatcttttctccgaacgttggagaactcggatcggtgtcgatcggtgtctgtttcagtgcgatacgacgcacaacgtttttagcaaccacatagagccagtcatcggaacatgccattgcttctgcatatttcgatacgttaccaggcagtttagcaaatgtgttgtatgagtccacatcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattaaagttaacgtagttctgattattttttgcgaatttctcgtttatgaatgcatcgcttggcgtaaattcacgcatggttgaatatgcgtaagcgttaagggtaaacgtccagagttcatctgtataaacccagtcagacggttcaaagcccttgtgcgtaaccatgacgcggaacttgtaaaaattgttgggctgaacatcggaagaaaaccattcgtttacataagcataacccaactggaaccaggttaaatcttcatctggaatagttacaccacctaccccgcgagtttctgccatttccacgacatagtaaaaatccatgccgacgctatcccacttcaaataaacgaagttagcagccagtttatcaacgcgcaaactggtaattgacggcgctttaatcatatgtttctccaaatttgcgttttacttatatcccatatttagcaaacaaaaaacccctgccaaatgacaggggttgtaaattattgactgattggattcatcgtcaacgttgtatattgaggacgtagatcgttttcaaatacaatcagagaaccatcacgggtgaaaatgttctcttccagaggtgtaccagtcagttcgatgtaagcagcgctgaatcgctcggatggaacgttcaggacaccaagatcgaaactaatgaaatcattaaaatgttccacatagccgacttcgtaatatttatcacgatcggttactccaggatatttatcaaaatcgttttctgtataggctgcgataccgatatcaccgtttttgaatggcccgataaccattttcgcgagtccggtcgtggtgttcatatctgttgacgcatagcgcacatcatacgaatcaccagcagcatttgtgtacttgaacccattcgaaacaacagaacgtgatttcacctggtttaagaagtgaataccagacatcggggcgctgtaatagttatccagttcacgcaatagctgaatagtcgcagaagaaccaatgatcgacacgtccgcgttatcaacataagtcaacatcttggatttactgaaagatttgttgaaaatttcaacgttatctgtgtagtatctgtcaatttcattgattacttgaccacgcaaccattcctcagactcgatcaacttactgatatcatacgttactttaacgctttgtacaatatacaggtagttcgggtcaaggatcgacggcgtaatagtcgccaggttatacttcgccagatagttttgcatgtcctctttttgaacagaggttaagcgcaaccctgatttcggtttaacagcgatgaacgcatagccaggtttttctttatcagtaaagcactgaaccgcctgaataacagaaccgaaacggtgagacaggaacgattcataatccgatgcagtaacacaacggcgctgtgtctcacgcataataggcgcgagttcacgaatacgttcgatatcttccggttcaccaccaccatcagcgcctacatagtccgctgaatcagtcgggttttcaacaatacttgtaatgctgatatttgtcaatgtatccacataaacaaagttttccgcaccattggcttcttcgccattggttgaaatatattcaattacaatagtcgaaccgtttgcaggtttcaagcccccgatgtaatccgcagtcagagcaccacctgcgacctgttggctggtttcaccttcaccaaagtaaacttcggtatgtccatccacagtttcacgcatgtaaaaaattgttgatgcgcctgttgcgtttacgatactttcgtttgtccagtcatcccattgagcaccgttgacagtaacgcgaacctggctacggtcgatgttcggatctcgaaccagaatcgtagaaccatcatagatgacttctgtacggactaaacgcccctgtacgatgttcagcatcgaaacatagttattgtctttgtcacgaacgatcaccacgtcatcagatacgacgaacgggaaactgtttgtttctttcactgtaccgatgaatttcgtgccgcgcggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgctttcagggtgttgaatagttcttgtccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtttcatgatgttacggatagccagcaccgcagaccaaagcgggtttggtgtttctggaggcattgaccagatctgcatcatacgcccgtacaaatccaccagagcaacgcaaccgttttggaacatcgtcaaacaccagtcaaataacgcgctacaagcgtctacaaggtcgcgagcgccagccttgacatattcaacggtgtagttgtaagaactgtctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattaatcagactccatgccccgcccacgatattaaacgcagagctaatgatctgccggaataccttcattgcggtttgccatgcttgctgtgacaatgccagagcacccgctgtgatttcttccatcccaatcgaaagcccgtcaaacatcgtcgcaatgcccttaccgttcttaatcgtacccgtcagcatatcaaaagccagcttgaacgttttacgagtctcgttccacgcagacagcatagcatcactgatatttgtatacgggaaccctacggtcgccggaatacagcccaatccagaacgagcagaaaataatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtaataatcaatgctggtaaacgcgcctgtagtctgattgtatacctgtcggattcgctgatcgcaacgggggccagaagtcagcaaataaccaccggagttttccaccttgtacatcgcgagttcgccagggttcttgaacagattcgcttttgacagatccgccccataccagtcattacccgcgagcttagtagccccgatagattcgatataggcatcaatatccgcttgagtggcgaaataataaccaatcttcgtaaccaaaatgtcagtagaaactccagggcttccatctggatttgtgggtacgtttggagagttcaccaccggaagcggatcgcttttctgcccgaaaggggaactcgtatacaggtgagttccgatcgggatgatttcggtcgcccattctaccccaacagcggggtaattttctgtgtgtccctgccagataacgcgtcggtaatatccagcagggatctcagcatcgcaaggatgctgaaaattttgcataatcccatcaatgatggtttcataatccatgatcatgattaacctacctggactgttccgccagtgatcttagtcagtgcgccggaatcaatgaaagtattattcgatgctcgcatgttgatattacgtgcgccaatatccaaatcttgctcaatatcaatcagagcattttttgcggtaattgttgcatcctcagttacggcaacggttgcattctgtttaacgttagccattaaattctgattcacgtttacggttgcatctttttcaacggttaattctgcgttgcctttaatcagccccacatattcaccttcaacggtttgattcacgttaccgcgcacgaactcggtcacgttaccatcaacggtctgttgaacgttacccatattgtaaatgaacgcatcaccctcgataacaacctgcaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggtttcgaataccatgttgtatggatattcagcattgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcattgatcttcgcagtatcacgggttttctccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcaccaaacgggtcacagaagcctttctgggtgtccggtttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccggaattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaatgagaacaacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgttgtatacttatgctgtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagctttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctacaagcagcagattgatgatgaaatcgaacgccgtacagcagaaaccgaagcccgacgcaaacgtaacgactatcgcaaaaaacacgcggttgatatcgtaaacgatttccgaaacagtttgaagaaaatgactgttggtgtaaccgctgcgaaacgtcagaaggattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctttacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctatctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaaagccccaaccgaaaggaaggggctttatttttacaggatactcacgatttccgcgagtttgccaggggttgcgccaggtcgaaccttcatcgcatctttcaggtttttatcaaccatcttttctgcttctttttcgttaaacccacgtttcaccaacacagcaataactttttcgcgaatacctttagcggcttcgttcaaatcttctgattcagctagaaccagtttagacagaacatcacctttgtattcctgggtaaagcgtttacccgataccagacgaggcttaccagaggcatctacaaccgtaaacacggcgtattcgcctgtagctttggttttggtacgtccggtatacagcaagcacatatcgttacttgggagcttgtacacctttcctttcaccaatgcttcatccagaggcagatcaatctcgaaatcttccgccaactgattgtacagatccaggttttcttcggcttctttgtacagggaagcgcctttgaatttcagtggcttgtcaaatttcaggtcatcagcaggatcaccgctgtagaatgaaacagtgcctttcgcccagtcaatatacgctgcctgagtcttgccagtggttttacctttcaggcggacaacacctttaccgaagtaagcgagatcgtgggagtctggcgcatacacatcgtaatcagcaccatgtgcaaaatgcaggaaaccgatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaagttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacacgctgttttctagcggtatcaaaaaattaagttctcgcgggttcttcatgagtaacgcagatgttatcgctcataaaatttgcgaagaaaacacccagccctggacgattcgccgtttgatgcaggtgttcgggactgatattgtttgtaaagtagatccgtctatctggacttcaattgcgcttcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagaaaggtttgacacctggcttgagtgattatacaatcctaaataatggtacgttagacgatttgaaacgcaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccagatttgcggtcttctggaaatcgacggttcgcagggtgtatcccctgatgccctgatcggcgcgatcaaagcacttctgccagcaacagtagaaatcgctggtgataatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaaactgcatacaacgattgtgtatagccgtaagacggttgatctgttccctgcctccggtatctctgaacctgcccgactggttgacgtggagaagtgggaaacgaagtatggcaatacaatcgtcggtgttctggaatctgactatctccatagtcgttttaaagatgcaatggatgctggagcaacttacgattatgacgattacaaaccacacgtaacgctcgcgtatgattcacatatcgaagatatcagcggagttaaaagactgttgacactgcccgtagatttgactattatcgaggaagatgctgaaccgttggatcttgataagaaagtcgaagacatcacggagcacatcgaacatcgcggcgataagtgggttgtactaaaccatgaccgcacgaaagaacttggtgaatatgattcgaaagaggctgcggaaaaacgcctacgccagatcgaatactttaaacataatgggtgatttatgaacagaacacgactgatgtctcgtatcaatgatgtacggaaagaaataaacgacttgtttaatattgttcttggtgatttctataccgtcaaggtatctgcaacaagagaccatattgcggatcgtttcattgaccgttctgcgtctatcaagaaagatttcgaactgtatcgagatatcttgattagtcttgcgaaacattattcgtgtaacgttctataccatgcagttaaaacgaaaggtggcggcgcacaagagcttattgcttaccgtcgcgttaatggtaaggtttttgcgtgtgtttgtaccgtccagttgtttgatggtgaagaaaagccagtgattgcgttacgcttacgcacggtgatccctgagtacgaagcaaacattaccacgcgcaacgcaattaacgtgaactacgtaccgcctaaaatcaagtttgaatatgacggataccgtcgcgttatgtctcgcctggatcgtctgattgcttctccagattgtccacctcaactacgcatgttgaaaaatatttgaaaaagcccttgcattcgtgcaagggcttttgttatattaggggtgtcgaaacaaaggaggcaatcatgaaactttactggctggtgttctcaaacgggtttgtgatgaaaggtagtgttcactgtgcgaaagcatattgtgaatggaacaaatgttctttccgcgtattgagcgttgcttcttctcaacctatgggtgactactgatgactggcgatcgtatcgttgataaaactttgttgttgactatggtctatattctggtaaaatacctggtatagagaaaagggaggggattatgagaaacttactgaacattgcagaactcttttgctacggtgtcgcggtttacgtcctgtttcatggtgacggtgcgggatactggatcatgtttggcggtggcttgttcctctctttcatcaagaaattctataagtgagaaatatattatgcgttcaaatataccttcaaacgtgtttactgtaatcaagccaaacgaattgaccattgctgacgttggagcgctggttacacaatttggtcgttctaccacactgggtcaattgtatagtgctgtcagatcgaaatacccgtataaatgccctaagtgtgatggaaaaggatacagtgttaaaaccttcaacacttacccttctgggttgcctgattatggatgggttgaccagatggaagatttcaaaatcgtttgtgatgtttgcgacggacaaggttacaccaaagatcaacttatcgccaaacctgttaaagtggaatatgtcaaagcatgaaaatcatcgatcttgtaaaagcggctaactcaatgttattgagtgaacattacgccgaatattgcgagcaataccctgttcccctggaacgtgcaattgctcaatccggttatgacggtatcagcgaaataaccgttgaaaacctgaaaaccttcatcgtgtttgctaacacgttctggatgtatctaccggataacccagggattcgccagcctactttcttcacgctgtgcatgttctgcgaaacgtatctcccagactgcgaggattacgaagaatattatggctaaagtatccttgttgcagttcgatcctaagctgggtttcgctttctacgcgcacggttttgccgacagcgccgaaatgatgttcaaaatggcgttcgggattgaccctgcaacgcttgatcagcaagtgctggcagacatcaacgaaacccgtacactgtattattaccgtttcgctgacggaacaaatatgatacaataccaatcgaccctcgataaactcaaaactgaactgaaagaaataggtgaattatgactttccaatctgaacatgacctgcaacttgctcaaatgatcaaagagcaaaacgtataccgcgatattaaactgtttgaagcgaacgaagatacacgtcgcgtgttctgggtcgaaatgtatcgtcgcgctatcaatgatagtcgtggacataccgaagcgaaaaaacgtgcagataatgcgcttgccgcatatgacgaacagtttacctctaaaggggtataatatggaattgtctgctggtattctctttctgaataacggcagcattctaatgggtcacgctaccgaaacgccccactgggatatcccaaaggggcatgttgaaaaaggcgaagcccatattgatgctgctattcgtgaatgcttcgaagaaactggttttgaagtgttcccagaccaactgatcagcctgggtgttttggactatacaagcaagaaaaaacttgcattgtttgtctataaaggcgatacttaccccgaagccgaaaaatgtttctgtgcgtcaaccttcgttaagaatggtcgaaccattacagaaatggacggtttcaaatatgttccttatagcgaaatccgcgatcatgcgcgtaaaactatgggacaccttctgactaaaattgtgggatatacatcatgagcaaaccaactacttttcaaatctgtcaaatgattctcgttgctaccgcaacccgtgccgctgaacctatcgcatacagttcgtgggattctgaattcgcaatcaagcatattcgcgaccttcctaatcgcctgatcgggtcacctgatttttctcccgtcgatcctaacgagttgacactggaagaaatgaaaaatttgggttttcgtaagtggagcagtgaatctgatttgatgctgatcccgttatatctgttgccgtatctgaaagagggtatcaccgtaaccgatatttccgacaatcaatactacttcttccgtgacggtgcagataacgatcatcgtatgggtcttctggcattcggtgttgtcccaaaggcataacatgaaaatcgttgatttcaatactctgtccgatatggggctgatctggaaaatcaacaaagaaatattgcacccgctggggctggcgttaacccgcgatccttctggtatatcagtaggtgcaattgtttctgatgatggtgcttgggaatacccagaaacctctgattttcaaaacatcgcaaaacttaataaagtttatgctatgcaagccgaaggaaagctgttagaattcctgcaacaacatacgaaataggggctaacgcccctctgaggattatattatgaatggtaaacgtgtagtcgtaatcggcaaatcaaaacataacgatgtcggtactcacctgatcattaacaacgaccgtggtgattggtacggcgcaacaaatgtaatcagtggttatgcgactatcgtagaaaaagatgctgtgcgtatagcaacccctgctgatcctggttattacggaacacgtgacgagttcgaaagtgaaaaggatcaagagatcgcagaaatgaaaacacaggttcataatgcgcgtgtttttgctgctatgtgtttcactgttgcggttgctgtaactggtttgttctggatggtggtttatcatggctgatgaaatcgtagcccgtaaccggattcgtgaacagataactttcagaagtcgcgaacatgcgatcatggttggaagttatatccactggtggaaaaacaatgatctggatctgaatccatcctatcagcgcccctatgtgtggacgcagaaagaacaagatgaattcctgactacgttgatcactggtttcccgtgtggtattatcgcgattgctgttgatagtgaattcaacgaatctcattgggtagaagtaatcgacgggaaacaacgcctgacgactatcatcaaagtctacgagggtgagattgggattcctatgccggatggttcccgtctgttctgggacgatatgcaacgacatgaacaacgagcctttgaaaacctgtcattacctgccctggggctggatgaatgtaataaaaaggatcgtcttgaattcttcatcaaactgaacttcgctggtgtgcctcaatcacaagagcacatgaaacgagtcattgaaatgtataaggcaacaaaatgaaaccaattagtttagcaggatctgcaaccccgtttgttactggtaaatggtactacagaaagcgcctgagtcgcttacatgaatacaccctaaaggctaaagggatttactatcctcaagtcatgcaggtacactgtgatgctgctggtaacgtgcgttctgttctcagtccttcggaaaatggtgaattgcgagttcttaatcgcgatattcctaaagaatactatattctttacgaagagttcacaccagtaactacagaaaatctgcgtttcgaacttggtaaacgctaccggattgctaaccgtggggctattgattccctgtgtaatctggatctgggtcgctatggacataacacctcgttacgtcgcttcctttctcatggtagccgccgtatgcgtgaccgtaacgtcatttatatccacaccgctactaaagacggttgtgcgttgaaaatactgggtagtgaccatgcaagccctattcagcgttcttttgattcgttgatccctggttggttgttgatgttcctggaagaagtaggaaccgacagagaaccaattgaaagagatccggtcgaaactatggtttcacagattgaaagtctcgaagacaacacgcgccgccaggtgaatcaggatgattatatcgaccttgattttgcgagtgttcatgatgaaaacgaatttcctgatgataatggtgttctagtcagtaaggaagattccgaacttctcgaagcggtgaagtttttaatcgaacatgcaaatgttgattacggttctcgtgcgatcattcgtctatccgctgatggatacacttatggtgttgatgatgcaaaaacattggtttcatgggctgcaaaacgcagacaggaattgatgcgatatagcgatgaactgttttctaaaatcaacgacttacaagcattaatcaaaaaattaccaaaataattcaaaaagcctcttgcaatgcagggggcttttttgtatattacacacatcgaaacgaaacacagaaaggggattcaaaaatgggtatttcaagcgcggttgcttctaaacgtctgtctaaagttgttggttgtgaagtcctggaatattccagctatctcactgggttctctttcggtgtgaaaactgaactggaagcgtacaaagccgcttacgtttatcgtaacatgccacgggttgacgtgtactacacggaatctatgggttactggatggttgctgtttacaaagaagcaaactgatgaactttcacgaacgcaaggcagcacgaaccgattattacatacggttcgtgtatggctggaaattacggaaatgtgttgcatgtaatgggtctgggcgatatgataaccacggatcgccaaaatgtagttcatgcaacggtactggaaaagaacgttataaacctgtgagggatatattatgcaacatgtgaatctgaatccgaaaatgaagaaatatctggatcgtcgtcatgataaccagaccagtaaggatcaggaactggcgttcaatattgaaaccgcaaaactccttactaaaatgtttcgcagattcccaaacaaggtaacgcataccagtacccatatgcgcgtagaactggctgataaacgttgtatcatggttaagctggcttacgggttatcggaagatggttacaacctggtgatgggttggacatcaatgatcggtaactacgttgaacagaacgatatcgagtttaacatgatgcgtggggatctgttccagtgtccggtagacacgatccatatcggtagcctttacgctatccttcgctcacaatatgaattatgggatatgaaatgattttagatgaagaattcgaaatgctgaatcgtgctattcagcaagtaaaacctgttatcggtgacaagtgggatggtacgaatcaaccaggttcgattacgggtaacgttaactacggttgcggtagcaacatgaagaaacgcgcgtttaccattattgggcctaaagcgttacaggcggtacaagaggatctgtggttgcaatccctgatacaatacatggtttcgtttgatcctgataccactgaacgcctccttaaagagattgtacttctacacaaggagaacgataaacttgctggagaacgcgatcactggaaagcaaatcatgaatgcgaagtgtcacgcgcccgtgtactcaaacagcgccctgatatgcctttggagcgcatcaaagcatatgaccgtatggttgagttggaaaaggaaaacgaagccttaaaacagcgtatagccagcctggagaacgtcgaaatgactcgtgtcatgatcgatatggcttcacagcgtggacatgagcaaacccagatgttgcatgaaattctgcgatatatgaaagcacacttcaaagatccggggtattactaatgtccttgttcaatagagagtgtaatcacgttgcgcggggctggaatggtggaacaccttacgcctttatgaagtattatgttatggatgggatcgaccgcatacatggtgatatgtatgcaacatgccacaaatgcgggaaagaattcttgatgtgtaaaacgcatcttgatcatgcgatccgtaagctggcagaacatccaatttctcgtgctgaaatccttcgaatcctcgaagaaacaaaatagcactttttgttaaagaaaccccttgcctatggtgaggggttttgttatattacacacatcgaaacgaaacagacaaaaaggaaatcatcatgaaacttgttcgcgaagcaatcaaactgggtaacgaatacaacggcaaatggtacttcatcatttacgacgacaacgcagaaaaactggaaaaagttgaagatgcattacgtgcaatggaaactggtgcttctgttggtggtaaagtgatgacctgggaaaactactgcgacggttgcccttgctacaacgatggtttcggttctggtttctgggttgagattgaagatgttccggcgttcaaagccgcctggaaaatcgctaagaaaatggcataaggggaataacatgaaacacattttcagcaactacctgaacatcaaattcaaaactgacggcgtgaatgtctggtggtggtcaagcaatatcggtcaatggttccctgaattcactgttaccgccgaatccctggagcgttctgttgcaaatggaaatgcttctgtaattagcacgaattgctaaaactcgataaccctgatctgttattgtacacacatcgaaacgaaggaggatatcatggaaatcatctacaaaagccggaactacaaaaaagaagatgttgcagcagtttacatcaagtaccggaacgtgaaatgtgagtatagcgggatctggggttacgaaatcgttgttgaagaagtaaacgccgacaacaaaaccatttgcagtttcaccactaacaccgatagtcctctgttcactactgaacagcttgaacaggcttatgaactgcgcaaccaggcttttaacgcggtacgtatcaaatgagattccgtccttatatcgaattccttcgcggtatcagtgagatcctgaaccgcgaaattaaacccagtccgttagccgttgagctttatcgactggacgcaacccccgaagatgcagcaaaagattatggaaatgaactatgactactgaaattgatattgttgttgaacaacttgttcttgaagatcgtaaaataacactttcctattattcggaagatgggtgtgaatcgtgggatgttacgttcgaaggttctgattttggaatgggagtttcctttagtaatgaagaaaaagcccgtgaaaaatataaagaatattgtgttctttacggaaaataaaatcgcttgcgctgggtgtgggatgatgttatcttacacccatagaaatgaaaccggagattgttatgttaacttttgaagagtacaaagcaaagcgtgaccagttaagcaactggcacagggagatcggcagggaattgagcgcttaccctaaaaatgaaatgggtatgacgatcgaatcaatccgcaatacgccggaatacaaagcgaaacgtgctttatgcaacaaagttttccaacagcttcgcatccttaacgggaagtacattaaactgtacaaaaaagaactggctgacgaacgtaaactgaaacggagtgtaaaatgatgcagcacgaaataaaaacagagattgataaacgcatcttcctggaaaagaataagacggtaacgctgatgcattactccaccaaaaacgggtctagtgagttctggcgtgttaacattgacagcaaagatcagggaacatcaatcccgttcgatagcgaaaaacttgctcgtgctgttttccaatcccacgttaaattttgagaactatatcatggatattattgaccgcgcacaaactgtaatgaaagccccttcgctgatgatttaccagcagggtaatatgcgctttgctcgctctaagtggtacaactataatttcaatgttgacactggcgaattcgctcgttggggtacaacctttgcaagcgatccgacatacgcacctttccccgaaattctcgatatcgagatcaccacgaaatgcaatggccccgctggtaagctgtgtggtttctgttacaagtctaacaaccctaacggctacaatatggatctggaatcattcaaatctatcattgataaaatgccctggttgactcaatgcgccctcggtgctgatgcacagggacaaacaaaccctgatatgttcgatatgatggcctatgcgcgttctaaaggcattgttcctaaccttaccattgctgatgtatcaaaagacgttgcagcgcgtttagcggcggttgctggggctgttgcggtatcggtttataaacacgctggcttcgatgtcgctttcgactcagtagcgaacctggcagaagcaggacaacagcaaattaaccttcacttcatggttagctcgaaaacctacgatgatgcgtttaacgttgttgatgctgtgaagaatgatccgcgcctgaaacaagtaaacgcgatcgtgttcctgggactgaaacaaaagggacgcggtaagaactgggataccgttacccgcgaacagtataaaaaacttgttgaatattgcctcgattctggtgtaggatttggattcgatagctgttcagcccctgcattcgttgaagcgatggagggacacccgaacttcgaacagtacaagcagtatgcggaagattgcgaagcgacaatgtttagctcgtatatcaacgagaaaggcgaattcttcccgtgctcatttaccgaacgttgggtcgagggtggttgggccgaaggtctgaacgtcctggaagcagatgactttatcaaagatatctgggaacatcagaaaaccaaacagttccgtaaagaactgatcggcaacaaggaccataacggttgtcgtaactgtccggcttatgcggtatgtggtaaagatatgcgcgtacacaaagcccctgaaaccgatgtatatgcagtggagttaaaatgattattacatcagaaataaaatcgtatatgcgtttatatgcagaccactttgtatacaatagtaattcagaggtggaatgtgttaactatcctgttaacgtagagcacgttttatggattcagaccgacgctaaaattccttgtattaacaaaacatggaaacctgcgattacgtttcatttagcacataatcagtcggtaacgtgggctggatatgaatgtgaagaagaacgcgatgctgttgttgaatacatcatcggttatatgaatactctcaaatatggtggatgatatgatttatcaatcctttgacgattcaactacaagaatccgtcctgttccgataactattgacattccggcagaaaagcgtacactggaatcgttgattgaaaaatatagtgggatgaccatttgttctgctaccgcgataatggcaatgtcagaacgcgatgctatcgtatttgaatgtgatatgaaaggttatcacactcccgaagatatgcagatgattgattatctctggaaaatcagaaatactgttgttcgcaaaatccttgcggaaaaagagtgtgaggaagaatgcagcagaatcaaaagtaaatggggtgtgttatgaccgaaatactcgatgaactgatgtatgtgtatcgtgaacgttgtaacaacgggcgtattactgaaccgaaagcaaaagcgattatcgaaagatattggtctaaactgagagaacatgacgcaagttcaaaactgctcaatagtctgatggttctgaaacttctgatcgcttctggtgatgatatgccgtgcgatacaaacagcgcggaagagtttcaaaaagcgtatcgttcctggggtgtaatttactcccgctcgctgggttcgtatgactctattatgtggaacctaatgcacctggataaacttatttgggaagtgctcgaagaagagggtattgtatgaatctttctcatgaattaagcggggcaatccgcactattgaaatgatgcttgataaacttagcgcgaaagaagaattttgtgtaagtgatatcgaagcgaatttagttgaatggcgtggtgctctttatggagcaacaaagggcaatgatcctctgttcgctgaatacgatgtgtataacgtcaagatctggaacactgaatatcgtttcaagtggcctggtgatgcttacggacacatccaaacgttttacataactggtggtatggtgtttgctaccagtatcggggctagtgaacttccaataaacccagatagtaaagtaacgacaccgaaccctttcagacatactacgatttgtgttggtatgacagaggatttttcaaaaaattatacgggctggattgaagcccataacaccaacttaaaaagagtgtgattatgtttaaagttattggatgtgtattactggttgtggttctcgttttattgcaatcaagctgtaccgacgaacaagaagcacaacgtatcctggaagcgcaagggtattcgaatattcagttcacaggatatagctggttctcgtgttccgaaaaagacacatacgcaaccggatttacggctacgggcgtaaacggtaaaccgatcgctggtgctgtgtgctctggaatgtttttcaaaaatagcacgattcgtttcgaataagtgttgacatgaatccccagtatgataatatctctctcgtagacaacgaaacggattaaaggggattcaaaatgagcttactgaacgaaattctggaaatggttgaagcgaataaagaagcaatgaaagagaaagatggttgggtagttgtttctgactgcttcaaaccgagcctctggactccggtttatatcaacgaagcaggtaatgaagaacgtggtttctacgaggctgcaatcttcgaaaccgctgaacaggcttgcgatttctggtcttacctgagcggtgacaagcctttcaccaaatacggtgtttgtcagtgcaaagacatttaatcccagccccgaaaggggcttttttgtaggtgaaatatgaccaaagcagaaagaattattaaccatcttcaaaccggattcccgtaccagggagatctacagcgcgatatcatcgaactgttatcccagcatgacgggatggaagcggagataaaggaattgactcaccctgacgtgaacgtattcgcttcactgatggatgatgtgatcgctatcgactcggacgaactgatctgtatcgagacaacgaacccagaagataagacgatcctgaaacaagcgtatgagcggatcgagggattacacgatcgcctgttccagttaactttcccaaataaaaacgatagaccttgttgacatcaaaccagattatgataatctgtatatgaaaactaattgtgaggaatatattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatgttgaacaaatcaataacgacaaacttcttcctgatgacaaacaggaaagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcacctgttgatttcggtgtacgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaactgggtgtaaaactgcgttacggtatcaactggaagaacgatccaaatcttcctattgaaacgaaatttatcgacgcaccacacgttgaacttgcataaggcgacaacatgatttcacaattctatgttgacgctgtaaagcagtcacgtaacctgcaccttgcgcgaatcattgatgggcgttgggggcaagaatgcggcggtgtgtctattttcgaaactgcgctggatatgggccggatgtcgggtaaaaccaaagcggctttcgatatcatcaagcagtcgaaagggacactgaatatctacgttgcgccgacaaagcaaatgggtatttgtgctgcggcagaacatggaatggataagggcgctgattcgtctttcattctgtcgaaacgtcaagatctgacttccattttccgtggacaaacgatcaagtatcaggcaatcaacctgattttcgatgaatgcgacatgacgatcgacgaacggtttgaactggcaaaaacactgaccttgtgtatgcgttcaagtcatcttcacccgttcccatatatccatattatccgtttgggtatgtaatgaaaagtcatggttattcatcaagaaccatacaggaagagattcaagggattgagtctcttctgagttatgtagatgttgatacatctacgggaaaagtgtattggaaaattcagcgcggccctatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtataaagcgcagataaacatagatggaaaaagaaaatttttggggtattataccactccagaagaagcaaaagccgtttatgaccggaaagcgaaagaggttttcggcacattttttaacgaaaccacataaggttaatgtatgtcaaaatacgtattagacaccaatgttttgattagtaacccatattcaatctattcttacatcgaacctgacagcgaaatcattatcaccgctgcaacgatggaagaactggatcacctgaaaagcaaagagcgaaccgctcatgaagcacgactggcgatccggcttttgtccaaagcaatcctgggacaaaattatgaagcaattacccaaacaggggtttcgttaaacttatcgaacccagcagtaccggaaagcgtaacactgaaaatcgtcgattatgacggcaccgaagaattccctctggataaacaggatgcgcggatcattgcaacttgtattcagcagggcgcaactctggtgactcgtgacattaacatgctgttgatcgcgatgtctaaaggttgttcggttcttcaatacactggcgatgactcgctgaaagatagtgatgtgttgtattcaggttatatcgacctgcctctgttctgggaaactgttgaagtcctggagtatgtcgggcctgttgccgttataacgtattcatcgcttcctgacgcggatttctaccctaaccaatacattctatcgtgtggtgagattgtagggcgtgtggtgaatgctggagagtttcagcttgaagtgttgcctattaagcacgaacaggcgttaaagcgtaagctgatgaaaacaatccagcctcgcgatgctctgcaagcgtcattcgttgatgctattctggacaaaaacaatgacgttgtgaccatcatgggcgcggcgggttcaggtaaaaccatgctggctgttgctggtgcaatgcacatggtaaacgcgggacacttcgcaaacctgatgtatgtcaaggcagatagccctctgtcgggcgaaatcgggttcttacctggtactcttggcgaaaaactgcgtcctgctgtagaaccatgtattacgagcctgaacattctgtttaaggatcaaccggaagttgacaagtacgttgaaggacttctggaaaaaggtgtggtgcagttccctagcctgtattacttccgtgggcgttcaatcggacatccagatccaggtaaaggttccgtgctgattgttgacgaatgtcaaaacttgagcaaccatgaaataaaatccattatttcccgttgcggtgagaacacacttctgatactatgcgggaacattaagcagattgacaacccgcgaaacactgcggttaacaacggctttgtgtatgctgttgaaaaacttaaagaatatgaccatgctagtcacataatcctgaatactgtgtatcgtggacgcctggctgcattcgtcgaagacaacttttaatcaaaggggcttcggccccttttttgtgaggtatacatgatcaatattattgtttcgccaaagctgattactgtttgcgaattttgtcgaactgggttagaatacgaactcgacgacattcagcgcaagacagaaaccatctataacgggttttatagtcctgctgattatatcgtgaagaagttcattacctgcccgaaatgtggtagtaaagtaaatttaaatctgaactgaggttattatggtacaagttgttagcagacctacagaaaaggaagttacttgttcgtgcggagtggttcttcggtatcatccttctgaggcgaaagtaaaagagatatcttcggaagggtcatatttctttaatatggaaacgatattgtatatcgattgtcctgtttgtcataaacatgttcgtgtggggaataattatggtacaagttgttaaaatgcaaccaaaagaagtcatctgtcggaaatgcgaaacacatctttcctacgatgctactgacgtgcgcgaagaaacgcatactgattacactggcggtcgtgacacctacagaatgatcacctgtcctatctgtcataataaaattgtggtgaaatgattgcataaataataaggtgagggtatcattgccctctcttgttacaaaaggtattaaacaatgaagaaaattattttagcgaccagcattttcttatgctctttttctggtcacgcaacgactgatccgcttggaaaatttattgaagaacttcctgctgtaaagtcaacattaccgctacaacaagcaacagtgatcaagaaagcaccagccaatgcccctgcatatgtcaaggaattggatgaaattacaccaaagcagaaaaaggttttggagtatgctttcagagttggaaacgactatgatctaaaaactgcaaagcctgttgaaacggaaaaatcgaaacgtttgggatatcatttagcggctattgcctggatcgagtctcgcgcatgtgagaacaccggaaagggcaaaaaaggtcatcatgcttatggctgttggcaagtcactgtaaacagtgcttccgcacggatggataaatcatattccaaacgcgtagtaatcaataagctcgaatcccttcggggaggttctaagtttgccattcatgaactggaatactggcttgattaccacaaaggcgacttgaaaaaggcgctcgcgagttacaatgctggcttcaagtatactaagaaagaagcccgtgagtatgctcgcatggttaaccataccgcgaaactgttagaagaaaagcaaattatttgatcaaaagcccttgcatttttgcaggggcttttttattatatgtgcatcaattattgaggattaaatcatgagtacatcacatcgagttattgtcggaaaatgcggtctcattaaacgaaacgcattgagtgttatccaatcagttctatccgaactcaaaaatcaacctaatgttaaaattctccagatcactgttgataaagacagtatgaaagcatttaacatttacttcgaatacggtgaagaaaagcgcaaactgtttgtgtatgaaagcgatgatgtgtatcgcaatatagaagactatccgatcgaatgtgacctatacttcaatctgaatgtatggggtagccacatagagatcatgaacatcgtgaaatctggcattcgtaaagcggtacgcgctgggggaatttacgaatgtgttaacgatgcaatcgaagaccgctttgtttacgtgttgggagagtaatcgtgaaaaaacttgcgctgctgttgactttagtttctggtttcgcttatgcggatatttcagacaaccgcctttctgaactttgcgaccatcgcgacattaaagatacttcggtatgttaccaggtgatcgcggaacaactggacgctgcttatgtctggggagaagaaaacgcgcatttagtcaaacgtcaaaagctggctaaacagcgtgagtttttgcagtctgagccgatgatgaacctctgtacccgcgcaccaaacaaggaacgttgtgaaaaacttcgtacttacctggtggatgaatataacgctggaataggattatattgatgctaggactaattattttttacggaatggttattgctgttggaattatcatctggtactgtttaatgaagccaggagaacgttcattacctgaatacaatgatgatcttgaaccgtggcaacgatgggatgaacacatacaatgagcataggtctacaatttactatactgatcagtgttgtgattttaatggggctggtcattgggatcggctatagaatgggtaataaagaatgattcagtcagacaaagaaaagctctatcacaagatcgagcaatttgctaaagcaagggatcgtttccttgacggtgaagccaaagcatcacaagaagcgatggattggtgggatgatatcgttgcttttgtcgatgatttaatcgacgtagaacgcaaagaggcgagagaatgagacatcaagaagaaaaggtgttaaaacataagctgaaagaactgggagaactttaccaggactacgcagcagaagacgatccagattcacgcaacctgaacatgacatatatcaataacatggttgatgacattatcgcgttcgttgaaaaagaagttgaagacgcggtagaagatgctattgcagaggaacgttctaaacatggctaaactgtattatcactacgcatcaatgaacgctggtaaaagtgcgcgactacttacagacgcatacaactacaaagaacgcggtatgaacgttgtgatctacaagcctatgcttgatactcgcacatcacacactgttgcttctcgtgtcgggttaagcgcaacatgcgaattgattgcacctaatatggatctgttttgggatatccaacgccggaataacatttcgtgcatctttgttgatgaagcacagtttctttcaaagagaaacgttttcgacctctgtcgtgttgtcgatgaactcgaaattcctgttatgtgctacgggttgcgcacagactttcagttgaatctgttcgagggttcttactggttgcttgcctgggctgacgagatccgagaacttcggggaatgtgtcattgtggacgtaaagcaactacggtcgcacgtatcgacgcacaaggaaatttcgtaaccgaaggggcgcaagtcgaaatcggggcagaagacaaatacgtttcgctgtgtcgtaagcattatcatgaaaaagtgcttgataaagttggcgtagactgttaaggtgtaatcagacaacaaaggagatatctatgagccgtacttaccgtaacaaatatgttcctgtccgttccaaagaatcaattgagaaaattgaagaatataaagcctatgcagcatattactctgctaatggttgtgatcctaatggtgggcgctggttctctacgaattgccagttgaaagtaggttgtatgtatatgcgtttcgataaaaacgttacgcgcgacggtaacaaggcacatggtgatatttccgctatgctcaacatcgcaaagaaacgtattgattcaaaagttcgtgaaaagatgcgtcaggaattgcgccggatgaaagctggtatgattggttgggatgaaaatgtcgaaaacgccaacaagatccgcgctcatgaacgtggtttatgctggtatgacataacgtaattatttttagactgatttgacataaggggcttttagccccttttttgctataaatatatacaggaatggatctattgttgatccgtaagcacttagagaattgctatgaacattaaacgcatatcaaaagcgctgatgtttggtttgttaatcttgtctccagcatcacaagccgacgaccgttctgttgtcgcgaaagaattcgactactacatcaatgcagcgctacaggtgtatctagacaccatccctcccagcgtaaataccagtgaacttttctataattacatggaacgaaaatggcagcagaaacagtgtaaatccgaacctgaatgcaaacgcttagggcttagggtagcaactgaatttgcttctattcaccgttcataagggatgaaagatgcagacgtttaacgaagttgtcgatcgcgataatgcaagtaaaatagatgcctttattggcagatgcctgatgtccgttacgtatatgcacagcgcacactttgctactggttcatattcgcaacacaaggcatacgagggtttttacgaagatatgcaggatttagttgataaattcaccgagatccatataggcattacaggacgttataaacccgtattaaaagttgaaaatatgcttgacacggtagcgtatctccgtaaaatagtcaccgaagccgaagaaatctatgattcagtagacagttcattgaagaacatcctggacgagataaaaggcttgtgctatcaaacgatttacaagctgacaaaactttcttaaaaagagtttgacaagcgaaaaagtgatgatagaataactatcgaattgaaacataaacccaaatggaaataatgatgaacttaaacaatatcgtaaacaacccaatcgtaaacaacccaaagaaaaccactctgatcgctctgggcgtaatcgctgctctgtggctggttccgaactcgtacacgatagttcaggacggtacggtaaaaactcaaaccttcatgggtaaagtttcaccgaaacctgttctgcctggtttccacctggtaaacccactggctgatttcgaggtgttcaacaccaaagacatcgcaatgaagtttgacaagttgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccaaaagcacaggatctgtataacgcagaagttcaaagccagctacagaccgcgatccagcaggaagttgaagagtatgcccgtccttacggttacaccgtgaaacaggtattcttgcaggatatcgacctgccagaagcgatcaagaagcaggttgaaaacacgaaaattcgtgaagaacaggtgaacgcagagaaagcagaactggcacgtaaagagcaaatcgctcaacagaaagttgtgcaatccgttgctgaccgcgaatcccgcgccaacgatgcacaggctaacgaacgtgatgctgatgcccgtctgtatgcggctaagaaagaagccgaagcaaacgccattctgcaacgcacaatcaccccagaaatgatccgctggaaagaacttgatgttcagcagaccatcgcggacaaatatcagggcgatgtacctcagactgtcatgggttcggattacgctggtaaagtgattttcgattctcgtaaataagggtttaaagccccctctcctgggggcttgattcttaaaacgagaatactataatgaacataaaacaggctatactaactatcttcatttcgtcattcttcggctttattggcggtttgcttggtgtattgattattgcgtctgttttatgattaccctttaaacgtggagcacgttatgaaatacaaatttgataaagctgtcgtaattggcagattccaacccttccataatggtcatgcagcgatggtgcgtaaagcacttgaagagtcgaagaccgtttacatccttctgggttcagcttacgcttaccctaacgttttaaacccgctgacggcaaccgaacgggaacgcatgatcactagctggttactgtctgagttcaaatacgaagatgtatcccgtgtgcaattcaaacctattccagactacctttacaatgaagaaaaatggaaaacctctgttcgtacagcaatcgaagaaaccaaaggcgataatatcgcgatctacggttacgaaaaggatgctgattcgtactggcttaaagcgttcggatggactcatgttcctgtagaaccggttaaagttgatggtaaagatttgtctgctaccgatctgcgtccgaccatctttttacataaaaacgggtgggatgaaaaaatcgcacgatacgcaccacgatctactgtgaattatattgattcctggatgatgaccgatacattctggcgtttgtattacgagttcgaaaaatgggaagacgaactggagaagttcaaaaactacccatacccagacgcgttaaactgctgcacgggtgatagcgtggttgtgtgtaacaatcaccttctggtaattcgtcgtaagtttgcaccaggtaaaggcgcgttggccctgccaggtggacacaaaaacgcaaacgaaacattcctggattgtgcgatccgtgaattgctcgaagaggttcggatcaaggttcctgaaaaggttattcgtggttcaatccgcaattcgatgttgttcgaccatccgaagcgttctgtacacttctcaaaaccgactgtggcgcagtacatcaagttagaaccgaacaatgatggaagtctgccccgcatcatgggaggcgctgacgatgcagcagaggcgttctggatgccaatgcacgaagtcaaacagaaacgtggtgagttcttcgatgaccactatcagattatcgtagcgtttacgggactctgataaaaagattaaaaagcccttgcgttcgcgtgagggcttttgctatattagggacatcgaaacgaaggaggtaattatgagcaagaaatcagaagtagccgaaatcaaaaaacttgatgatggtaaaatcgcggtacgttggaaaggcaatcgcaaattcaatgtgattgaagatcccgaagtcgctgctttcctggtgttcatgattacccagaaagatacattcgttcctgatccaaacaatataaggctggctgattaatgaaacacccttactgtttggtaagtcgtccgatttgtgcgggtggcttacctgttaactgttggcagttgattgaaaaaggtgacgcgttcctgaataagcgcggtgataaagtgtttgtgtatggtgttgactctatcgaaaacgaaacgatggttatcaccgatgaaaaaacaagtgaaaaatatacgttgacttctgatcatgattgccgtaactttaacgtgtactggaaatctgatgaagaatttgagaggaaatcattatgaacaaaactgcatttatcaaaacagaagaatcgaaagttgtccgtcgcgctctgatcccaggtgatagcgtctatatcaatcactcgaaatctcgtggattcaaagaatcgttcaccgttcaatctgttgcaaaagacactcaaagtggcgtaccgattactgtgtatgtgtttgcttccgacacacgtactaaaaccgcatcaactatcatcgctaaagtcggttctggtgatgaacatatgttgatttccgatagtgtgtattctgtgaacattcatagcattgatagccgcgatgtctctgcaaaagatacaacggtcgttgttgatggtgatcatgtattatcgttcgcgctcaatactcgcgaaaaggtagaacgtcctgttgctgttggtgatattctgaaaacagaacgtcgcacataccaggttgaatacatcgctaaagatggttctttagtgtgtcgcatgtactcccgcaaagataaagattcttatcagggtatggctattattgacggtgttgaccgttctctgatgtctgcactgtatacgaaggtgacgtttaaatgaaacatgccagaagtgttttgatgggtgatgttatcgacatcaacgggaatgattactacgttgcggaaatcaacacaaagggtaatcgtgagatcctggaactggatattgtgaaatctgcgatgggtaaatcacttactatcgaactggtgcataatacgaaaactggtgagaatgtcactactccggtattgtctaaacttcctgtgttttattgtgaaaagaaaaagtgttggaaaatgaaatgactgatttaagagatttgtctgatgtgaaagtgggtgataccctgtacgatcctggcgtaagtcaatacaacaatcgaaaaactgcgaatcctcgcgtgttccatgtaatcaaggttgctcgtcaatacttgtacgcatccccgaataataagaatgctgatttaaaagattggaacgttgagaaagtcgatcgtaagtgcgggttaacttctggtactggcggtggatggggtggattctacatgtatcgcagcaaaacagtatatgatgaaattcaatatcgtgttatgctgtctgagaaaattcgaaaagaattcggttctcatagtgttcgtgttcccgaaatcgcgacttttcaactgaaagatattgcaaagatgttaggtattgatacatcggagagtgaagaatgaaaattgtaatggaaactgtgttcggttctcacctgtatggactaaacacaccgacaagcgacaaagactataaagggatctttctcccgcatccacgcgatattctgctgggtaaagccccgaagactatcgacacgagcacgggcgataaaagttctaaaaacaccgtagacgacatcgaccgtcagttgtatagtctgcctaagttcattagccttgcatgtgatggtgataccgtagcgctcgatatgcttcatgctgatgatagtaagctgatcgctaactccgaaatctggcagtatatccgcgctaaccgttggcgtttctacactacagaattaactggcctgttcggttatgttcgtaagcaagccgcaaaatatggtgtgaaaggttctcgcctggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgtaagtctgtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagttatgggcgaagtcgaacgccttgcagcgatttcaacatatccgaaagaagttgatcgcgagttctggaacgatttcatcgaacgcatatacagcgatcatgttgtggggtattacaaatgatgtatcctaaattgtccggcgctgaaattgatgttctgtataaactttacggatacgcaactaaagtgctagacttagatttcaatgacgtacccagcaaatcagggcgtgattccctgattcaaaaaggttacgctcgaagagtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcagttacactggaacaggctgttgttcagatcatgcgcgatagcctccgactggaagttactgaacgtaccgaaagcaattacacgggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtacctgatcatgatatcctgctcgcggggttcccgtgtcaggcgttcagtaaagccggattgaaactgggctttgatgatgtacgcggtacggtgttcttcgaaatcctccgcattatacgcgctaaaaagccccgtgtgttgttctttgagaacgtgcctgaactgctaacccatgacaaggggaagacgtttaaaacgatttacgggcttctggaggccgaaggatataacgtattctatcaacgcctgaacacaaaggatttcggactaccccaaagacgggaacgcgtgtttattgtctgcttcctggatgatgtattcttttcgtttccggttcccccgcgtacccctacacgcgtaggcgacatcctcgaagatgctgatgattcgttcaccctgtcagataacgcatggaagggctttagagagcgtaaggaacgaaataaggcaaacggtaagggtttcggttatcaggccgtcacaagcgattctacgcacactgggactatcacccagcagtattacaaggacggcgttcaatgtctggtgttgcaggaaggaaagaaccccagaagacttactccccgtgagtgttttcgtttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgcatccagtagttgatagtggtatcttagctttaccaaaacgaaactgaaaaggaacataccatgacttttaatgacctgtttaacggatgtactggcgctggtgcgaaatttaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggcaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatctgaaacaaaaggtaaagtatcgtgaaaatttatactgttgaaagtttaagcgaagattactatacatttagtgatttggtcggttctaccgtatcgctggaacgtgcgattgaaatggctaaaccttttgactgggtaagtatcactgaatgcgacggctttactggagaacgtctgcgcatagtaacactgagcaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggtgattgcgttccgaactgcggttactacaatcctccgttaacagcggaagaagtggtcaatcatgttcaccgtgacttaggcggtcatctgggtaatagctttgaatcgttctacgacgataaacgctatgactgggaaaccgaagaaagcgcagaaacccgctaccgttcaaaccctcaaattgcgcttgcgtatgacgggcgagactggtacgatctggacacagaagagaaagacgctctgatcaaaatgtggttgtatgaagagtacaacacgaagtatggcaatcaggacggcgtgtttatctatgaattcacgtactccgatgaatgcggcccgatcggaactcaactggaacatggaaacatcttccgtaaccttgaacacacatcaaagagtcatcactgatggataagttaaaaaccgaagtctgtgttgttatgcctcgctatgcattaggggattcgatcccctttagccaggatcgccccgcaccgtttgatgtattttctttgcgaaaatatcttgaacgttttgaactgaacgagtatactctccaaatcgttcgggtatggaatccggtaatgtatgcgcttgcgtttgacattgcagaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaataacaaatatcgaattcaaaaacgctgtatcgaagccaaccccgacaaaccacgttttcgtgtgtgacgtatccggttcaatgtataacgaactgcctaagatccgtaaacacctgaaagcaaatctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctactggttgtactggcttcgttgagccgttgaatctggctgcggaaatcgctaccgatctgcaatccgaaaacggcaacctgaacagcctgatcttcctgacagacggttatgataactgctggcgtaccgatgacatcctgaaagcgtgtgcggttctgccactgactttcaacagtatcgcgttcctggaatacggttattacgtgaatcgtcctctgctggaaaaaatggcagaagcaaccaacgcattacacaaattcgttgaaggtttcgacgcatacgaaccagcatttgccgaaatcatcactgcgcaaacttctgcacgtatcgaagtcaaagttgctgacgctacccatgcgatctacctggacgaagggcgcgtgtatgtcctgaacgctgcaaacggtgttgtgctggttccagaacacatcaaaaacatctgggcgctgggtgacaacgcgatcaatgatgttgacggcttcgatccaaacatcgccagtgaacagcaagttctgtatgtcgtgctttatcatgcactacacacaatgaaccctgatctggcatggaaagtgcttcaaaagctgggtgatgtccgtctgatcaaagcgtatgacaactgctttaccaaacaggactactccaacgcaaaagacctgattgcacaggctgttgtagatccgtcacagcgttttgttgatggtattgattacaacatggttccagacgaaaacgcgttcactctggttgatgcgctcgaactgctggcacaaactgacacagtgatcgacctgtcttctgagcactgggcgtacaaccgcacaggccgtcagactgtacagaaagaagatgatacactggatcaactgtctgaacagatcgcaaacgctgcaaccccagaagaacgtaaagcactggcggcgcaaatggtagcgcatgaagtatgggttccgaagttcacccagactacaaccaaagtatcggttaaacatctggtgggtaacagttcccgtcctaacatttccatcaacacggatctggaagggtatgtgactatcccagaaagcaaacagaaagaattcggtctgccggaaaaaatcgaaactaagcaggtgcgtaacttcaccatcgttaaagatggtatcgtgaacgttaaagttctgccgctggaaaccgatattccgacactgaaaaaccttcgtgcttctggcctgactatcaagccgctcgaaaaaatcggtgatgatcgtatgtctgttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggggtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgctcgtttaagtcgcgtaatgtacggtgttgtagtagcacatgcatggttcgcggatctggacttcgaagaaaccaaagtttctatcgctgcgaaagatattcttccgaaagaagataatattccgtccgatttctggaaagtctgggaaaccacatcattcgaatgtgaaattgtcctggaagaaaaagaagtcaaaatctaacaatgtccgcccccgaaagggggcatattgaggaaaatactatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagatcgatttagtcgggttcccttacaaaaagggtgcaatccttctcgaactggaagaccataatttcttcgcccatgttggcaatatcggagatcatggtgaattcggtatcgaagatatccgcgaaaacccgtatgtattcagcaactactacaaggtcggcggacacctgcgcagtgataacaaaactgttctgtatctggatggtcttctgtctggaatgcataatttcagcatcgagaagccaggcaacagcgcagaactctaccgcctgtttgagaagtacaatcatcaagatggtaaactgttgccgtcagaaatggcttacattgtcaaccgtctgatcatgggactacacaaaacattcctgattcactttgacggtgatgtacaacaggcgatggaaactgtgatcaccatcctgaaagaaaaatcacgctgcatggataccctgtcaaaatgactctattctttatcattgcattgggtgtgtttattctgggcgctgcgatttcattcatggcgttcgataagcgcgaatatcaaatggttgtcattggccttatcgtggcaagtatcccgctggtgttgtcatacaacctgtatcatgagaaaatcgcggagaacgcgaaatatgaggcaagacgatgaagattcgttctgggttcgtgagcaatagctcaagcagtagtttcattatcgggataggacttgtccgccctggtaaagaacaggaagttgcaaagatttacggtgagtcaaacgttgaatctctgatggatatgtttgatgatactcgtcctcgctgggatttacctcaaatacacgatgacggcacaatcacactggaagcgttcggatgtaatagcgtagaaataacccgcatctgggacaagttgaaagaactgaatctggatgatgttaaaatcgttcacttcaatgagtgcggcgacgaaccggaatacgacgaggaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttgcctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatgttcgggcaatcatcgaccggatcgaccgttatgaagtagggaattacacggaacaaaccagacgcactacatacggaaagattacgagtatgctggaacaaaccaaacaattcgacggagccaacatcgaattgattgatgatctgctaaaaaggatcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaaccgatcttgatgcaacatgtaaagcattgaattctatagggattaatttcactctctataataaattcagttaatccaaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctggatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttacgacactatggacgaagtatatgaatatgtgcttcgtggtgaggaagtgattaagtcctacaacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgctgcttcctttgattcggatctttattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgtaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatctattaaagtatcgcggatactcccgatcgtgctgtcgagaatgcgtgatgctggactggttgcgaatacaacactaaacaagttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcgcctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcgctggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttagtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggtgatttcacaggttccggttgcttgtcaatacttgcactgctttccggtactgcggcgatcttgttctgccactggtcaagcattgagcggaatcgttcgctatcgtcttcgtcaagtttcttggagttgtttttctcttcgagtgattcaagaattttctccattgctttcttgtcttcgttggtgatattttctttatcaagaatctgatcaccacgatcgaaatcattttccgctttcggcttctcagccttttgtgctgcttcgatctgtttggtttcgtccacgcgcttacggttagcggtattctctttatcaacctcagcttttaacagtgcggggttttcctgcaatgctttcagttctttcttcttctcttcggtgatcttttcttcgatagccacacgatcgcgcatctgttccaattgcttagacaatgctttctgtgcgtctgtttgttgtccgaaactatatgagaatgcgccctgggtagccttaacctgttcgacaaccttagaacgtgcctcaaccactttatcattctgatcctggatctcctgctgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacactgtctttgatgtccagtgtattcagcgcggtttcaagggtgttatcattgatatcctttaactcacgcattgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgccttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacagaaacgcggtatatgagaacaacttccagaacccagacaaacagggtcaaccgttccaggctgtgaagtgtcagacgttatccagctatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaatgacaccagcaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcgaacagttcatcttcggtgtaatccttgtttttgtccagatcgagaatgacgcattgccaggtgtcttcatcactggtttgctgcatcatcaccagcgcggcgtttttgaaccccagattatgagcaagcatttcatgaacgaattcgcgatcgtcgtcttcataacggatttcttgcccttcccaacggatcaggcggatagttttacttggttctgatttcataatttattcctgctcatgatttcacgcaaacgcttcgtcggttctggtggattcttaatgatttcctgaatctgattccagacttcttccgaaacttctttcctttccatgataacattattcgggttatcacagcattttccaaccataacacaacgcccacaattaaggcagattgtgtccggtatcgttggagcattatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattagaagcgcaatagatcagagtcgggaactgaacttcgttattgcttggcttctcgtcaaacacatacacctgaatgttgttgcgagttaaacgcggtgcgttcatgccagcaatcagagccagaaaatccgctttcttagttaagtgagccattgacataatcttttcctctttccgtgttgtttcgatgtgggtaatgtatcactacactacccaggaagcaagcattattttcatttttcttctttgaagcaaagttctacttcaacgttgactaaacagattgcgatatcccatgaatctgcaactgggtcatatactgctttgtcttcgtctgcaacaggcagagcaacaacccaaccatcaacaacacgtttaacccgaagtctttcgaataatgctaccgcttcgcccaaagactcaccaccattcgccagcttttcaaaacgcgcacggtctgccaggttgattactttgccttcgagttctttagtgatttgcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatccggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccataatgtattcgcgatccagttcaccacgttcttctaacgggatgtacacgcggttaataccgtcttcatcgtatcggtagtccgtatcagtcagaccggaacctgtgttcgttctggcttctcctgataagtcctcaaccacaaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcatagttctgcaccaggatagaagggatcagcttgaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaccaaaccttcatactcatttcccgcgcgggttgctttgcggatctgattctctaacagatcggacatacaacgcgcaccatcggctttaagctgcgagtaagcagggaagcgaatacgttttaaggctttctcgctaaacggcgtagcgaggcactgaggctgttctggaatgagtttcttccatacgcggttcggtaacgttgtacccgcaccacattccagatcgcggttaatgatacggcgaagaacttcgcgatcattctcgttcactgatgatacgatatccagcaaacgatcacgggctgcgttgcccgtatattttcgcgttgccaaatcagacatcaaatccgcgatagcattcgatagcggggttgtgcctggcttaccgtccacctgcgggaacttcttaatgtgaaacataatctgtttcgtgtacgtaatgcggaaaatctcttttagcagatcattacctgcattacgtttcaggatcgcttccttctctgaaattttcagagtcgaagcgagttcatttagaatctgtaagatcatttaagtacctttcattatgtgtaaaggaaacgagtgctttggccttatatgcttcacttgcttcctcggcagaatcataaaatcctaaccacttagtcactccatgtaaagtgattttggcgctatatttttgcgatttcttgttgaatgacacgcccttaaacccaacggtattatttttattccgtgtgcggttttgttgatttgttacctgattggactcccttagattagaaatcatatcaccgcattcaacaccgtgaacatggtcaaccatcactggaagataaccattaacgtaataaaatatcacccgtgaccggatgtacatcgcattttcgaattttattcgcgtatatccacttgatttatgaaaagaacctgcttcacttccagcaggaattttattacttctcttttccaaccagaaacattttccggtttctggttctactcgaatacattgtagtaggttttctataccttgcgtttcttcatcaagagttctcaattgctttttcaatttcatgccagttattcactttagtatgaggtacactcggttcactacgttcgccacgcaacatatggaataacggcaactgactgatgacgttatgacactcattcaagtttactgcaaggtcatcaatgaaacatactaaacgatcgccatattttgctttggcttccaggtaacgatgtactttcgtttcgccgtgaccgacaacacaaacctctttgaatgcagaagggaacagcgtgttcaggtttgcaatacggttaaggcttgccgtaggagtggttcccagcgccgtgacagccacgaaatcatatttgactttcagacggttgatcacaattaacgcatcgtcatacgcgcttagatagcgaataaacgaactgttgttgtattcttccatgagaattttcgccagttggtgatcacacccaaagatttcagtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatataacctcataacggtcgaagaaaagggaacttttaaacgcttgtatatcagcgaggaattgatcacgctcgaatgtacgatagtaatcaaattcgatgcacaacatatcatcgtttgttacaccaatgccaacgacatcttgatgatatttctttgcctgttgcagaacgaaaggatcgagatccgaacagtcgaaataaattacgtaactcattatcaacccttgtacatataaacagcgtcgaagcctggaacatccatttcgactttatcgaacacaatatctttcagcttacatttttcaacgtagctgttgatcacgttcatgttgtttgcgccgatggtaacgtaatacacacccgctttgtagataacacccataatcagggtagaactcaaagcgccctgtgcgtggagtaatgccaacgggttaatcgcgcctttgaacaggaacgcgcattctactctttcatcataatctttcataatatctctcagtcaaaaaatagtgcgaatacgaaccacaccccgaagaaaggccagaatagcacaatcaacggaaaaatggtatgttttaaaatccgtgttgctggtgtgtgataaccgttatgactaacaccaaaacaccaggaaaaccttgcagcacagaataaaccaacagcaaggtataacaggataccgaccacaatcaagaaaatcataacagatcccttaatctggttaagttgcgtacaaactcacgttcagtgagtaccgtttcattcatcttattctttcccattgaatgagtcaaggtactttttccggttgcagccagcgcacggcggaaaccgtcattcaggaaaagagcattgtacgcgttttcaatcaggatttgatacgcttctgattcacggtgaatcggcatacccttccagtatagggtatgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatgggtatgaatcaccactaccaatattcataataactctcttaacgtatggtctacatagaaattcattgattacatcaatctcttcggagattgttctttctgttttccccgtataccttcatacaccgactcgattaaaagatctttttcgaatgaccgtaacattatgaacaccacccgccccgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcaaagttaagttgtcttgcctacgtggttaaagatacaagaaagcctgattcagtgcaagcattattttgcataaaaacgaaaaaagccgctacctttcggcaacggcttgatttttaatacttttcgtcaggctggaacaccgcacgacacgcccacatagaggcttctttcagtcggtctttcgccagttggatttgatggacacgttcaagcatcgcatcgagttcttctgtggtgaatgaatcggtatctgataccgcgtaatcgcttgaatactcttcatccagttctttgaagatttcgcccagggcaatttcagcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcgtcttccagagtttcacggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaacacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgtgatggatcggaaccaccttctgttttcgggttgcccttccaggcgaagtctgattgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacacccgaaagaatatccaggggaaccagtacaagccagcttgcgtatttcaaaaagcgcatatgcttctccagaaaaaaggctatccgaagatagcctgttgattaacgaactgcgttgatatacttatacgcttctgcgaattcttcttccagagcttcatttgtgaacggaatatcgttcgatttgaagccaccgctgataagatactggataataaacacagcagtatcaatagaaatcaactggtgatttgttggttcgatgtcagtacggcgaaccacgtttacgatcgaccagtcaaagaatatacaatgacattctttcttgctgttcgcctgtggtgatgcaaagaacccattcacagaatacgcttccagtgcattacggaacatattttcgaaatcatcaatttctttggtaaacattttcatcaatttaccgttgatttctttttcagttggcgtagcaacgatttcgcgaatctgtggggttaattcaaacagcttttgaagacctttcatatttttctcttttaaatttcatacgcggagtcgatgcaagattgttcaagattaccaggtgaatcttcaatcagtggttctgttttaccacaaacatctgatgcatacggatcatcatcaacataacattcattgaattttaattttctgcggtaatcatctttatgtaactgcattttccattctctgaatgtcatcccatatctttctcgaaattgaactggcgtcatattcttgaagatattgattgtttttcctgttgatggatcgtatttggtattttcacgaaattgcatatagacctcattaaatttatgggctggaagtttctttacttcaccccgcattccggggaacctattaccggataccaacagagcctatcgcatacgataaggttgcatattccgaaccatttaacggcattgcgctacgcacccgaattggagcaggtgaagggactcgaaccctcaacaatctggatggaaaccagatattctaccaattgaactacacctgcgaattttttagaactgcttgcgataaatttcgcgaaccagcgggtcaacatctttcgcgtatttacatacgtcttcgaactggacgatgtacgccatgacttcatcggcacgggatttcagtttaccctgatgcgcgtcaatgatcattgctgccattacgtcaatacgcgcgggggcttccagaatttcgcctttgtcgaacagttttttggacttgctgacagtatcagcgataattgcttgaattgatttagccattttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccatgattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttttgcaagcgtgaaatccattcatcattaccacgatcgtatttatcgagataatacaccgatgtaatcgccccgctagcaacataccattcgatatgtttcgcgcagttagggcaaggcgatgtagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacgacacgaccaccaatcgcgataatagcacctacacgattcgaaatacattgagaacgttgactccgatcgattgctctcaacatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcgtattcaacaaccggacttgttgcaatgtcctgttgaggatcgttatcaaccaacccaaacacacaaccataacgaagcatcgttggttcagtacagaaccatgcctgatggatctttctgattttgtcactcataatactgccgcccatgttacgaatttagttaccggattccactgaatcccgaactgctgttcaacgatgttacgttgactcagaatacccagaaggaaggagaactgaccatcgcggacaatcttcactgtataaccagcaggaattttatcagcaatgcgctggcctaactggttgagtttcagttgtagttcaacaggattctcaactttaacacgatcacccagttcaaccatcacattttcattttcacgaataaccataatattctcctttgtttgtgcgggtatcttatcacacccgcacccactgtcaactgttttttagaagtcgccgtaatcaacctggaaacacgggataccgttcattcgccacatcccgactggtgtatccctgtcgtccactgcaagaacaggataatacttatcgagaatcttttcaacaagtatttgctcttttacgtggaaatcgtgacgatgatcaccttcttctcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgatcacctttgtgaagtcatacgggctgcgttgtccaactttggtcagtgtcccgtcaacgtcgaagataacacatttcggcttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagcgtgttccccagttgacgtgctttttctttcgcccatgtagttttcccgctacctggtacacctacagtaataaacagattcattacacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattaaccggattcaccttagcggggagtgtaggcaaaatcttttctggcggcttctccgcgcacccaaccaacagaacgcccagaacaagggctaacgttgcaattttcatttgtcgtactccgccatatactcttcgaaggacttgttgatcttgatttcgatcagtcctggttttttaaacagcagatctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagtgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcgaccagcttttgcttatcggtatcatcgaaataacgcatcataggcccgaagatgatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacacccagatagccggaatcacagaaggtggagatcagggaaccatcttccttaatcatcacatccactacggtttcaccaatcgtcacaggagaggctttcagtgcttcccatgcctttacctcagcatagttgaaaaacttctccatagggcgactggcgagttttacgggggtatccccatccattacaaacatgatgccgcgacattccagcgcaccaggttttaaccagtcggaatagctcgccatgcgatagttaaagatgcgaacattggtttgcatcacagttttttgatcaatgaagtagaagcattcgctttcgttacacagtttcatcaactggttgaataaggttttctgatttttggttagatttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatgttactggggtttgcttcccgccagtatttcgaattgcggtatgtgtctaaccgcttccacaaatcacgacattttccaacatacactatccgaccgtcgatttcaataaaatacacacaatgccggaattcgccacatttaacaaaactccgatctatccttttgtctgaacccagacgcaaaggaaatattacaccaaacgttacatcgtccattatatatccaacttattcacctttccggtcaacacattgacgcagtgagcaatataatcaccgtgacacggtaagggtttgcaactacagcctaaccgcttcccgtccagttctttcagttcgtcgattgtgatcacgccagttcgaatcaagttttggaaatacgggatgaagttaagaatgttttcaccccgtgttcccttgtaaaagggattgccgaacttcgtacctctttgaatatcgacatcccaatcacttttatacttgtttacgacgcgacaatcaagcgtatttttgtcgccattttgcataggcttcgtcgctgatctcagtgttgaggttgccaaccaggtaagaacttacttcaacctcttgcggggctacctgtacgttgtcagacttcaaccatttgttcatccacggatacgggttcggcgttggtttaaatggagactgcaagccaaccgcgcgcatacgctgatccgtcaggtgttcaatataggcgatcgtacttttcagggatacgccgtctacatcaccgatagagaacaggtgttcagcccattctttttcctgttcgtacacttccaggaaaatttgtgtcgcttcctcttcgtactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaatgtgaaggtaaacgacacgtagaagcggatcgcttccagagcgttgacagcgtgcatacacaggtacagagcaaccttacatttacgcatttgctctttgcgtttcttctcgtactctgcgatcgattcgtctgggtatccgtgggacgttaacatttcgattttgagcacaatatttttcagttcatgacattctgcgatcagatcatcgtagtattttgtcatggaagcagaacgtttcatgatcgcttcgttgcgcagaattttatcgaactctttcgacgggtcgatgtgtaaattgcgctgaatgtgtgtatagctgcggctatgaattgtttcactgaacgcccatgtttcgatccacgtttccattgagacatcggaagcgatagggaggaacgccaggttcgggccgcgcccctgaatggtatccagcagggtttgatattgcaggtttgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagtttgtgtttgcagagatagcctgatcaacaaacttctgcataaccgctacatgagacagataacctttgtttccacgttttgccattgtccagagataatcatagaagtcaatctgattattctggtttggtactacctgattgaatgaaccttctttcgaagatttcacactcacagggccgcgtgggggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcacaatagttgcttgccagccatgatgcatagttggtgataccgacgcccagagaacggcgctgtttggctttcagagccgctgcaacagggtagttctggtaatccaacaggttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacagcacaggttcgacatacgaaccggaacagagaaactaccctgctggtttacgtgatgactgttgaaaatgtagttgcgtccggtctgtgcgcgttcctgaacaagcaactggaacagatctaccgctttgatgcgtttcttgcgtaccgttgggtctttttcaagactggtatacagttcttcaaactcagtctgatccgcttgatagaacgcgtcatacaggcgatcgttcgcaacgtcagggctgaacagagtgatgtaatcgttattgattaaacgcttatacatcaaatcgttaagctgtacgccataatccaggtgacgaatacggttttcttcaacgccacggttatttttcagaaccaacaggttttcaacttcaagatgccagatcggataatacagggttgctgcaccaccacgaacaccgccctgggaacaggatttaaccgccgtctgaatgtgtttccagaacgggataacgcctgtatgtactgcttcaccaccacggatttttgaacccatagcgcgaatgtgtccggcgttgacaccaataccagcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcgcgttatagaagtcaaccacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgaaaattcaaaatctttatcgtgattgattttcgattccagataatcaatctccgctggagtccattttgccaggatttctttatcgtatttcccagcgagaaccatattagcgatgtggtcgtagaacggaatcgggtcaaactgtccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcattacgagcgtcggaagtggaagcggtgcgcgttccggcttcaacaactctttcgcttgttctactgcgtttttgtagatatggacatcaccgccagtccaaaccagatcgcccacttcatacccgcaaatatcagcgataatatgcgtcaggagagcgtaggaggcgatattgaacggcaaccctaagaagacatcaactgaacgctgataccactgtagagacagtttgccgttgattacgacgaactgaaagaaacagtgacacggacgcaacgccatatcatccagatcaacagggttccaggcagaaacgatgatcccgcgatcgtctggtgtggttttcagttgttcgatgatttttgcaatctgatcgacaccagtgtaaaaaccttcttcaccaaacgagcgccattgatgcccgtagatcggccccagataaccattcgtataacccagcgctttagcctgattttcgtagttatcgtcccagatcgtccgcttatcgctatcttcgccccacgtcattttacgcagtgtttccacgttggtagaaccggacaggaaccattgtaattcatgcttacacggtttgaagaatagctgtttgctggtagtcgctgggaaaccttctgcgaggttccaacgtgcttgcatcccgaagatgcgcagtgtaccaacaccagtacgatcggttgattccgtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggtgcattgaaagtgtgatgtccgtaaatgtgcgtcacaaccacttcgtcaaccagtgtattattgattgcttccagaagcaaccccttaccgccaatgagacacacatcacgatctggatgcgttgctttcatcacgtcgattgcagcagacaacccgccgccgtggatgacataatcagcaatatcgccttttttggttttgaggaaactaccagaaccagacagaacacaatggattcgcccttgcaatttaccaggcagagaagtaaaagtgttcgcacccatgatcaggacgctatctgcggtttctgctttgaagttctgtaaatcctctttgcagtgtccccacggtaaaccctgttcataaccgaaagcatagtccatttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaatccgttaacatgagcgttaatgattttggattccagatcgaacaccatcacatctaacggactccactcaacagaatgaagtttttcgcgggttaacagggttgtgtgctttggtagtttcattggggtacagtttgccatagccattgttccattttacgtaaatcttcctctaacggagtgaaaccaaaggattcttcgatcacaccgtcttcccatacatcaatttccagaatttccgttaccggagggtttgacatcacatgatcacgacacgcagccatagcggtcataatggaatttgttactgtcagggtatttccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaaaggaactgcttttcaacagttcccagtataacacagtgatttagtatttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattccacatgtttctgaccggagtgcatgaaatcaaagctgctgaaactccagaaacctttgcggttgctgatctcgcgtttgaagtggaaagtcaaacccgcgccgttatcaaactcaccgtagttactgcggaatgttgcccctgcttgtttcagtgcgttgaaatagtcatctttattgatgcggttaacggtgcgttttggtttctcttccggcgctggtgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatattgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtgtgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggtccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatactcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcattggcaacttcgttttgcagagtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacaggccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggttcgctttcgctcgctgttcgtcaatgaagcgctgatgtgttgcgatctgctgctggatgtgattaccctgcattgagagcgtatccaactgctgattaacaccgcgaatgtatgacttgttcagcttatccatttcactgatgacggacagagacagcaaatcttcaaccagtttccggcgttctggggttttcagttccatgaatggggtgtaacccgctgtacccagaacgataacctgtttgaagcccacaaggttgatgttcagcatagattcaagctgtgcctgataatcacctgctgcggagtcttccggcaacttctcaccgttcttccagatctcgaacaccttcggcttttgtccgcgcaccactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttctttgccgtatcaaattccagttcgatcggggtgttcccgaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattcgccccgaaatattcatcataacggctatgcacttgacacctccgcgtatagttcgctgatcagcttattcacttcctctttttcatcgtcggtgatctgcatgttggcgatatactcagtgataagaccacgaacggttttgatttcaaagtcggtatcgacatccgaatctgtttgaactttgtctatgatattaatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaactggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatttaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgttacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaaccgtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctactcacggcgattacgatgcttgccctgtgtgtcagtatatctctgaaaacgatctgttcgaaaaagcgaaagtgaaaggcagtgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaagtttggtgttcctggcccaatcaaaggcatcgaagacgaagcgcgtcagaaagaaatctttgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccattccaacggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgatatcctgaaaaacttttcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctgggcgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcattaccgcgaacaacatcaacgggattcaccctgcgctgatctcccgctgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatcatcaaagctattgaatccggtgatcatttgatcaaccgtctgcatagcgaagacatcaaactgtctcttacttgcaatctctctgatctgcgcacctacgcatacg

SEQ ID NO: 156 - DNA, 44717 bp, Unknown
  source: /note="Description of Unknown: M16-9-1c Bacteriophage Sequence"
cgcactgagagcgcacaggaagcgccctagtgaacgcacaaggacaggcatagggtagcactagcgatagccctagaacgcagcacaggcccgctgaggccctctggtgcgcactagcaggcccacccagtgccccccccccccccctaaattgacgctaggtaccccctatgggggcaattggcgtcgttgagggtgagggaggggctcgcgtgagtctaataaatttcaggtccaggtatagacctgctcgcctagactgggcctgggttttacgctgtgcattagaagtgcagcaccaagctagcccgagtagccccgggggtaattggagcagccccaggattaaacagagtaactttgtaggagctgtacccactgtagctactgacaccggctagcagcccatcaacagacccgttaaataccggagaactcaaaccgacaggggcttgagtaatcccgtatgggagagtctgtacagggctagataccagcgtaccggcagctacagcacctggggtccacgcaaagctaaatggaacagaacgagcgcgctctactgtaataccatccaggctcagtgtgtttccggtgctgttggtgaagcgcaaatctccgtccccagttaggctgttacccaagtaaaagtctacatcgaaccaccctggaccagccggtaccgcagcaacagaggagccgccactacccactgctaaggttatgttaccagtagcgccggggttgtagactcgcaaggatactcgcactatagacccgagaaggtgcagcggcaactggtaccgacgcatctcctgacccgcaggaacatccagtgctacagtactagcagccccagccctagtggtacgactagcagcggcagccccgcgcatgtacgcctgcccgataaacccagggccgaacggactatccccgcgcactacgttcatgttcccgctgtatacgcgaggcgggttgatgcggcaagccctagtactactcagtgaccaggatagaacactgctggcatctgcaatgttcgcatcattgtcgaaggcatctacataaccaccttcaatggtccagaattctccttcgcacccatacgccttgttatcagaaataacaataggaccaacagctccagacctaatacgaatacacccggcatacaggttatggtcggagtctgggcggaagtgcgcaaaaccattacgggtaatccaagagcgtgacagctgtccaaagtccagtacgtgctgcgtggttgtgttagctccgtacggtacactatcccactcaaacttattatccgtaatccacaccaggtccgggttactgtttgctgtactcttaatccacgcaccagagcacaacccgaatgtgttattctgaatgtgcaggttattgacgttattattaggaatacctatgtaatcccctaggagtataacactgccgttagaggcacccatcctgcagaataagtttcctgagatgtgactctccatacagtcacgcaacaccagcgcagatcccgctaagttattaaaagcagagttctccgccccaaaatagctccaggaggtgacttcaaccataagtcccgaatcactgctgacagccccttgcagtcgcattctgaggaatccgcccccagttccacgtgtacttgtaccgtcaaagtagaacatcttagcagctgtgctaggtttaatgaatacagccccaagcgggttgacgccctctaggccatcacctataaacagcatagggttagttaggtggcagtccccaacataataagaccccacaggtacgcgcagcacctttacacctttagcggaaacccgctcaatagctgctgcgtagttgccggaagaatccggtcggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacgttcttatactgattcccgatggctttgctctgccactgcctgcgctcccataggccccagcacactctattgcgctgcccgttaatatactgggagcagtcaaaggtccagcggttgccgcccttatacacccaaccggtgcccggggacttctgctggtacttgctaatataacgccagtccagtacagccttcccggctgccgcataatcaaggctcttgagatgccgcttcacggcactgccattgaagccagctacacctacgttataaatgaagtctatagacccaaccagggctacgtcagagagctgcataggaagcccgtcaagggcctttgcgtgttcccctgctgattgtatcagttgcttctgacaatcgctcagcgtggctctctggcccattttaacgcccttggtctcgccatagcagattgtagggacaccggcgctatccttgtaggcggtaaggctcaggccctcgttgtgctggactacgccggtaatggcaccgccgagcatagtggcccccgtgagggccgcaataaccttagtccttaaactcatatttaatagtccccttacgtgcctgctcctctaggagcttgaatgtacgtcgcttgtaatacgcattccacgccagggttagcactgcgcacaccgtcgcagtgatgaagctgatagtgctccagttccagctcattaactctgccaaccaacctcctgataccgtagcgccggtaactgctgcacctgcccgggtagcgaggtccgacccaaccatgtctcctaccttaatcatcctgctgccccttcttcctgaatagcttacgaatcaccagaatgaccactaggaagaccaggggaatgctggccccagctaatccggcgaggataagactgtaactatcattgttaaccacctgcaggcgttctgcctggattgtcccggtgctaatagtttgtacctgcttcttactggacgtgtccagggtgcctacgttagaatctgatacatcggttttgttggtggtgctggcgtccaccttgttgttcaggccaacggtttgcttggtgttttcggcaccaacctgagcagacacatccggcttagaaccaactaagccggtgagtgcagaggtcgccgagcaaccagtcagagtaaccgcgagcagtaacccagcgaccagtttacgcattagctagcagccttcactgcggctactgcggcttcaagcgcagcaatcttggtgtcgaaggcggctccagtctgggctacgttctgcggctgcgtaaggatagcatacaggtccttaccgagaatgttcagctgacgcagcagctcctgctgttgcgctgaggttgcttttgcaattgccatagtattactccttactcaatagagattgctgtgattacaccatcttctacagtgatagtcgctgctacggtggcagtagcctctgcctcccgagcggtggtgaacgtaatgggtacggttacttccgcaccattactgaccaccactacagtgccgccgtcagaggcccctgcagcagagagtgccgctactgctacagccccggctgcatctacatccggacccagagtatctaatgggccagtatcatgtgctaaggttgttgctttatcaagtgctactgctgcattacgtactgcctggcgctgtgccagtgttgcttctgcaaatgccattatcttcttcctctatgttgtttacctctgccccggttctgtaaccgtgcagctacaccccgaaggcccttagacactttgctctgtgcccaatccagcgggttatcaatgaaggcccgagccatcttctcagactcacgctcagccaccactttctcatcttccaccaggtgcccgttcagcgtagccaccatcatggcgattgcgtcagcgcggtcatccttagccagactaccacggtcgtacgtaatgccagacaactgcgcgaacgcagagtacagccaacgcctgtcgcgggaatacgccatacaggtactaatatcatcgtgaatagcacgctcatgcactaccaggcggtgacgacgagtaactgggctgattgtgtcgatgatacgacgctctttctgagtggagttgttcagatcccgtacaccgataccggcgagacgtcgctcccgtaaccggttcaggataagcatagacacggtgccatgccccatgttgctctccaccaccatatccgggatgtctagctctacgcacaggtcaatcagtttatcaatgttctcttcgctgatacctccttggaagccgcctacggagaataggtgaatgtacgagttcgcagcgccgccagcagcgtaggacacttcgtctccgccacaaccagccgggtctactaccagcaccttatgctggtacggcaggtgcatgtccccgtagaatgccgggaagtacatctgctggcccataatcccctcatgctcgtgctggtacaggtaccggcggtccgcaatgtaggagaatgtctccggggaggaatcctggctaccggagtaaaccagcatatccgaaagcttgatacgcgtacgcatttggtcggacagggtggtgtcaagcatgtactgcagctggaagccttccggaccgaagtccagctccttctcaatcagcgcatcctcgtcatagcgcccggtgtcagtgctctcgcctaacgtcccgtcgacgccgaagccggtgcgtttatagccgcgctcaataagctcccggatataaggggcaagtgtacttccatatcgctcctccatttcaacagacggaatgcgcccgggccacacgcggacctcgaagccacgtcccggcagggtcttatagatactgtccttggtctgtggtgtgcccaggtacagcgtatccccgtgcgtacagatagccgcaaagtctttcgaaatcatcagcagctgctcgcgctgggtttgtgttaaaccgttcttggtggtctcgatatcatctggaatcagcaggtccgcgcgcttaccctgcagggatgcagtgatacctacacaggctacgctggcggacttatccagaggtttcaggtcgcagttgacatcataaccttcgaatgaagtacggtccccacgagtagggtcagccttcaaatagcacagcagcggccaggtttccagcatacgaatgattaagttcgctacatcagacgcctgcttctctgcaccagacacaatcaggatacggcaggattggtcctgtatgagcctccagacagcgtagagcgcagctagtgtagacttagcctcaccacgctgcgcggccaccatgcgcttcctagggcccttctgcatgtactctgcaatgtcggcctgcatgtccgtgagcgtaaaaccaaggaagcgcataccgatgtatgcgaattcccgaaagtcactgagggcagccgccatcatcatggcgatatcctcgcgctcctctttgggaatactgcgcggattcgcactataaccagtaagtttctggttgagcatgcgcagtcttcgtgcagtcttcaccgataccattatacaattccttctagtaagtcctcagagtctgagccaccaactttatttagaatctcttgcttacgcgcctctctacgcgccgctagttcgtcatcgaactcgtcgcgaaggtcctgcatctcctcggaatctgcgtccgcggtgatgtcgttgtccttcaagaacttagcgataaccgatttatctgcggcggggagcggcacctcgtcttccttggactgcttgatttcttcaatcaaggcctcagtgaacatgcggtgcagctccgagaggcgactgcgtttagccgcccctgccattatcttaccctcatagctctaatataaccctgggcagtgcaggtcctggtaaaggtggcctgcgctaccaggtatacagtggttgttgcactcaacagtagacggcgcgacataccctgtctggaagaattcccagctgctaacgtggtggttatagaatataagtcgtaccagtttccaggtaacactgcactggtgctactaactccaaaactgagagcagtaacgttgccgctattagtgactaacagggcactctcaagctcgtactcccccgccggcaggctcaaggacagaacgttcaatggggtgccgctggtaacacttacggctgcagaggttgcggcactcagtacttcccccactacaccggcggctgcagctgcaccgtcagtgcggccggatatacccccactcaatcctgttaatgcggtgatgtctccgttgctgccggacgccgctgctcccaggttagtcctagcagtggcggcatcgccagctccggtgcccccctttgtaattggaaggctgccagttgcccctaaggtggcattgccagaaccatcaaaactggccggtgtagtggatgtcaaatctaccaccaaagtccttgctgtggctagcttcgcagctgaatcagcggcaccagtagtgttgccagtaccgccttgagctttactcagcggtgtagttaatccacttaagctcgtgatatcagagttagcaccctttgctgccttggtcgctactgctgcttggtaatccagaattatctgtgcatcggcattagccctggctgacgcctcttcccctaatgccgtagctgtagcgtaagtttccgaaagctctgcatcataccccaatctggcagacactagagtaccagctggaagtacctctgcaaacagtagagtgttatccaccacctcaaaactgtagcccggaatctgatttacgccttgtacgtacactatagcctttgtgaaagacaatccaggcgtaacttcgtcagtagcctcggccagtatagtataccagggatagcttaccgtaggctcccccgagataaaggtctgctctaggttggtagtacgaacatcgagcgcatcgtctgcggctttgcgcgcggcggcttcggcatcaatacggacacctagtgccgcatcaccagtatctacatagttcttggttgccacatcctgcaggtcttctgggtccgctacgttagtgatgcggtacccgttcatgcttatattcccgtagaatccggggatagctcggccttccacaagctcttgggctaggtgtaagaattgcgtgttttgagaatctacgttcacctcaatgaacggagagccgctggcgaactcaatatacaagtactcccgctcagtcttgcgaatgagcagcaccgtagtgtccgccgttaaggctgtgttcagcctgatattagtagagctggtccaggtgtacccagtggtttcctctccgtctaggtatacatgaatataggacttgtccaaatactcaatatcgcactggatatcctgggtaccagctggcttgatttgttcttgccagctgaacgccatattaatcgtctccgaagttattgatgatagctcgcgtaggtgcgaattcctggattaacggtacctgcttagtgaaggtcttgatgtccatattaccagtagccaggtcctgtacggccccgagcagccctgtgacataacccatagacgccaacgagtggcggggagaatcccccaggaagatatcctgcagtaaggatcccccgccgatggcactcatacccgttacggactcactgatgagtttctgggtgtctacgtccttcccatccatgccatgcttagccatagtagccagcagcatcaacgggaactggtatgccataatgtgggctacaccaatccacccagcatcgttcagctctctacgcagaatcttgttagtggcagccagtgcgaagctctggtaccctacgatgactttgccgatagggttgaactgtgcaaagtgtgaggtctctccagtacgaatctgctgtaccaggtagtccatcatacgcgcccctacaacctcaacttgcatctgcaggtccggctggaacatggcgcccgggttagccttattggcagcgatagcgcggtccgcaacatctcgggtaagcccgaaacgctccagacgcttaaacgcctcagcatcacccttgaacatctgcgtaagctcgtccgccacaataccggagttcaggttaacctgcagccgatgcaccatgctcataccgttgacgtggcgtgcagcctgcccaacgttctgagtgacgttgaaccaggaggcctgacgggtcaggtccaggttatcgtcagcgtacgtattcagccagcggaagcgcatctccttctggatatttcccctcagcacagtgtctaggcgggcagccatatccggagtcttgatagctacggcaccttccttgaaccaaggttggtctcgcatactgcgcagcacacgggccataccaaactccttcatagccaacgcagtgtcggtcagctgatacaggccggagttcttgagcatagtggcgttagccatgttcccggctgcgcgcagcaagtccggaagctgcccagcgtcagcaggtgccccacccaggataaagtcgatggtgtcattgacggtcttctcccacttagcagaatctgccagtacgtgcttggactcgtcaatcatcttagcgagctgccccaggtcctgtacgcctgcataggccataccgacacgcccagacatacggttagtgtacccgtgcataaccttggctacgtcagtatccatcaggtcctgcatacgcatgctctttccgttaatcaggtactctttgtccatgttgaaccgagtacgctgacgcaggttccgcgcaggggatgtgctgcctgattctcgtacgttaccagccaggaagctctggattgcagactcttctacaccagcgctgcgcatagccatgacgacctcatcgttacccatgccgttaatcagctgcttccacatagggccagactgtcccgcacggccgttgtagataccgtcaaccatctccttggcaacacgctgcactacctctgactccatgctagggtacacgtcccgcagggcggcccggaacagggctcggtagtcgtccagagtgttaccctgcgcgataccttggcgcatcttgtcgtagctgtactggcgcgggaagtagtagtcggatttaaccaacgcaccatcatccactagaccggcattgagcatatgctcgtgccacttgctagcccagccagagcggcggtaagcatcaaccagcggagcaatctctgcatccggcaccggcacagcgcggccgtttacgtcagcactgtaggcagcatccaggtacttgctcaggcggtcctccagcgcagcccgctcagcgcggaaattactccgatggaagaagcgtgagagcacccctacacccttatccttcaacgcgcctaggatagcatcttcaactacgctggcgcgggcatccatctccaaagtgaggttacgcttgtagtctaccactgacgggcgacggccgcctactgcagacgcatccgacactagcagtttagccaagtcttcgttgccttgggcgatattatcgtacagtgcaaacatagtggagagcttcttcttagcgccgtccagcatagcttgtgcacgcttagcctcgttgagggtagtgctgcccgccaggtcctggaaagcctcactacggaagctctgggcttggtctgcataatccttagctgtccacttaactgcatcctcatacgcatccagtacatcctccaaggcagagcctttggccttgatgcccagagcgttcatgatgtactcacccagttggcggagcatgctattgccggtgggagactgcgtacgtgccaggtgctcaacccactcagggctgtcgcctaagcctgccagcatctcgtgcacattacttgcgtaatatcgcatacgcggtgtcagggtggaatcagccgcaataacagcgcgcacttcctccaggcgtttagcaatctcgggattactgtcaatagcgcgcgcagtagcggcatgaatcagttcgtgcacggccaccttgcttgtatctgcatccatagcgcgcagcgcatcaccgactgtagtccaggtgctgccgttagcttgcttaggcgcgcgcagggatatctctccccgcttagctaaatcttgttgtgcataagtgtagcggctgcggtttgcggagcctgctactagtttaaaatcaatgtcatttacagcatcgcccagcgtgtccagaatagccttctgtcctgctgtcaagtgctcagacttcctcaagaactgaactacgtgctgtgctttcatgttcacggaggcggtattgtttctcgatacttggatgctttcatccagtgtcttagtgagaatttcctctccctctcctactccggtaacattagcatccctagctgtacgagttgtaggcgcttctgggtcgaacataggctcacgcccagtacgagccttggcggcagctttagcagccctagacatatcccagagctggtctaacccagctacgcccgctatcagtgcagttaccgcagcagactgccccagttggtcctgtgcatagaatgcagtacctacatcagcagcgcgtatagcggtacgtgcagctaagcccgcacggccagcaataccagcagcagacatcggggccaggatgaacggggaatcccctaccaacatacccgcgaacccagctactgtgttgtcagccattaagcggtcacggtcacgctgctcaagcatctgctgcatgcggtagttgtaatcttctactgacacggagtcatgcaggtactcaatctcttcctgatttggggcgtacagcttagcccgagtatcgctactcagggtctgcttggcattaaagttcgggtctcggtcaaatgccggggcagaggccttgcgtatagctgcggcgatgatgctgttgcccatacccgaggcaaagctctctgcggctgtagtagctggggtcttggcctgtgccagtaatgaggcacgccccagtgcgttcagaccgttgtccccggcatcgttccaatctacgcgctcaggcgcagatttaagtgttgcgcccttagcagaatccttttcctgtggattcggttcttggttcagaaactgagccataatatctcctaaaagaattttgataaggggaggccccgaagggcctctggttagtgcgttgcttcgaagagccaatcacgtaggttttgttccaggtacttcttacgcccaggttgggcctgcttgtacgccggggtattccgcagcgcttgccaagccctaccctgggcctcagatacagggtactgatacgcccccaccggggacttagcagccttgcgtacctgtgccatcgcctctgctacggggccggagctaccgttaccaccgtgatagttcaggtccaccataacctttaacgcctcgtcggaggcagtcaaaccctgtcccttgagttgcttctgcacgttcggtatgtactgctcctccagtgaggatttgaggatactgataccgtcgtcaatggtaactttctgggggacgggcatgccagagttaacgtgcaggccgaagcctacgctacccttacccttgccttctcggaacccttcgaacttcatagtagtggctaggatgtcactaaacagtgatggttccagccctaccgagttacggccatttacttgtacgctgacggcacgcccgttgtcgtggtcgtagaaggtggcaggacgtacacctacttgctcgcttccaatcttcatctctccagccagtgctgagtcatacgcagcctgcgcagtcgtctgaacgtctcgaaggttcacagacatcgtctggaaggtgcccttcttgtcgaacacggttacggtcatgttctgacctgcgttgccagcggtggcggcctgcactactacacgctctatgttgctggggtctgacatatactgaacctggttctgtatatgctgctgcagggaggccttgaactgctcttggtcgcccttataatcacccatgatagattgcatagaggtgccagcgggcagatacacatgcctaggtgccccggcaatgtccagctccagcttacgggattggatattgccttttagcatcgtattgatgtcgtcagcgtccttccctacaagggattccggattgtggttatacacataacggtactcatcttccatagcagctcgcgcttcctggcgctgtgcgtctgcatccccgaagaagctgaaccagttagccgtgccgcttgggtctaccatcttgtccgtggggttactttggatattgctgtagcgcccactcgccttattacgagcctggcggcgaagatcgtccaagatagtgttactggcattatttgggttttgcgtaacagctttctgcaccactccacgccactcagatgggacctcagacagcagcgccatcttccctaagtccgtactggtgctataagcctgtgcccacaagttgatgctattgacgttctcgcgggaaacctcgccatcttcaccgagctggtccagcgtagtcagcgtacgtgccatatccgaagacatacgcttgtgcgcctcgtttacggcccacgcatccttgctgttgcttccgtatgccagcagctgcaggttcccttcgggggtatccggaaagctcttgagcagctgagtacgtgccttatctaagtcccctttgaacatgcccgccagagtagagcttggcatattcccagtaattgctgtgcgcaatgcttgggcgtctgctgccttctctcgaatggtctgggctttgttccagaactccatgctggtcccggcgctaagtacatcagatgccgacagctcaatgacacgactacgaatacgctgcatagtctgttcttgctgctcaggtgtctgcccctcaagagactgtattgcatcagagatttcgaaacgggcctgtgtctcaatctgagcacctgcgcgcttgaactcctgatacagtgccgcgttgacatccacggagttgacgccgagttccttggtggccatttcctgcagctggttaattaccagtgggtcctgcgtctgctgcgctacgctaaccagatactgcttggctctgtccagcttcttgttcttgtccaagtgctcggcagccaggatactgtctaatccggtcttgatagacatctgcgcggcggcaccctgtcctgcctgcagacgctgatagaactcatcgctggacgcactcagtccacggtctagggcacggtcagcctgggccagggcgaacgcagcacgtcctttctggaaggctgtatagttagccatgctggtagcgcggagctgctgcagtatactcgtagcagactgcttggacatatccgggagatacaccccgagcttgtctgccattgactgtacgtgctcttgctcctgctgctggaattcctcgtcagtcagccctgcctcggcagctttcttagcccgggctatgctgtctgtgcgccacttagctagagtgtcgtacgctgcggcggatacgtagccgtcctgataggcttcgcgcacgaagatgttttgcttctgtacagcctcgtccttggaggccattgcatctactgcgccctgagcatccatagcgccgcgcacggtggcggctgcggcgttttcttttactgccgcgtcgaaacctacgccgaagtcctgcacgaatccagacagggcggctaggcgttttgctttggaggtatcaacagatacttcacttaccgttgacggcaagctaacatcgttggattgcagttgcacgccaccgatatttaacccctgtctactgggttgaatcacaggcatttagtattcctcctaatttaccaggtgtgaactgggctattgcccttactcccccataagtcataggaggatgccatgctctgcgtagctgacgctccgctaccaggcgaagagctaccagagtcagtagacgacgcagcgttaccagcgtactgcccaacggcagatgccccgacactcaacaacgagttaaacatgttatcgtaggggtcctccatgtccatgttagccaggccgctatccacggccttatctgtcattagacggaagccctcttcctgagttgcctgctggtcacgcacgctggcctcttgccgcccggctacagtgttcaccgtggctactgcgtctttaacagaggctcccatagtgccggaagctgctgcctgcagtcctacttggctctgtgcctgcagcttctgctgctgaatgttaaacagagacacctcagtccggtccctggactgggcgcgctgtagcgcgatgtcgtttagctgtttggctgtctgttgaatcacagccttgttcctggccttggacacttcaatctgagcaccctgccccagaacggtcttagcggccatggccgcaaccatccaccacatattaaatcctccgtctgcgttggttgtagcgcaggatgtacgatatatccaacacgttcagttccatagaaccgtcagtaaatagtgacacctcggttgtgtctgcgttagtgcggcatggtacggtaatcgtagccaggtccatacgcagggcctgcccaagcgtcagctcctttgagttcatcaagataccagtcagttccccaccccaattgacgtcccgcggggtgtctagtacctgtacgtcgaagtgcccggagttacgtactgccacgtccaggcgcagcaggcgcacatgcccacttccctcgagcttgtcattctggtcccgtagaataggcgtagttagcgtgaacgtactacggtaacgtctcccgattacataagtgccatcaggtacaccgcgcacaacccgtagggtgttctccccagcaatctccttgatgccaacctcagtaggccccatagggttgctgggtaggtacgttaggataagctcttccttgtagttgtccgcccacccaaccgggcgcaataccgacgggacagtgaacaccccgtcctgcacttgaacttgcttctgcaaatccgagtaggcttcgcggtactctgagcccagctgataaccttcgcgcgggtccatagacacaatcaaaagcttgttgctgggactgggcccttgcatgtacaagaacacctcatcctccagcgcctgtacgctcaggattgggtacgggaacgaccacttatgccacgccgcctgcatcttagcgccgtcacttccgccccacatgaactcgtagaccagcaggctgttacgctctccagacatgcgcgagaaggccatattggtgacgctggagttttgcatctgcaacaccctaccggggatataccgaggtaggtgcaccgtggcatcctgcgtagtgtactgtgccgcggtgtaaggtgatgggattagctccaatatacccgcgtagctgtcgttgcgcttgttcgggtagattactgtctgccccgccattaccggagtcacacggctgtcacaatcgtaggtgctggtaatactaatgcttgcgttagttggcgtaagtactgccgaacccggcacaaccgcctgcatgctgttagcaaataggaccaagtcccggttgaactgcacagcggtgcggtacacagaatcctgggcagacgcagagctaatgctgatacggtccgtatccagcagtgacgtcacagtagagcggtagaatcgctgatacaggcccgaggcggacatatccacagagctaccactaagcaggaccaggcggccctggaaagctgcaataccagtgatgtagccattctcgacgaatcctggattactgttgttatcgtcgttaccagctaagcgcccctcccaatcccgcgcaatgatgttgtcatccgcggcgagctctctgggcatgttcgtaatcttggtgatgctatcgtacgcccccacctcggaccaggtgcgggtgctgtagctgaactgataccacgccgtctcagacgaggctgtacctacacggcacattgccccgtcagcttgcgccgggagctgtgcaggaaggtcctgctcctggtctacacgtgactggttggataccacggcataagtatcacccgcgtcagaggataccacgcagttgctcaacccgtagaagaacaggtacgcaccacgtacgctcacgttcccggagggcagcccgttcgctacaagagagtcccgcagctgctgggcaacgtaggcacctgatacctcctcagcgttaccgctcgtgctgccagcagccggtgcggtgtagtccccagtgtagtccacccccgcagaggtaacggtgacgttccagcgtttctggaatgctgcggatttaacgtagaagaacccggtggtgctggggtcgatgcgcccagtattgtccacggttgtgttcggggccatctccgtattcaggatataagtcagcccggcaatgcttgcggtctgcaaagaggtctggcctacggtggtaacaaagtacgggtcattgccggaattaaggatggtctttccattcttagccagcaaccaccagttaccgttgctggtgttaatcagcaggtgcctaccgtcagtcccacgctctacgtattcagtgaacagggaatcaagcccagggctatcgattgtgctttcccagacaatctcacccggcggcctacggcggatacctgaaaccgggtcgctgagcatattcagctgcgcccccagttgcccgggctggcgctctcttggaacctgctgggagacgccctgcagcaggctctgaatggtaccctctagggactgggccatatactctccttaaaccataaaacgagcacggcggattctgcgtgcaaagcgggtcttgctggtgctgaacttctgattgcgcagatgctcgcgcagcaccatgctcttgtaccgctcagcttcctgtgcgtaattagcgtagttgctgtcgccacccaggtcgtttaagtatacctgcgcagtggtgtagttagccacccacatagcggcgtgctccggcaggtcctcaaaggccaaatccaggaccacacgaatacgcacaggtgcatcgaagtattggttctgctctaccaggtcgtatagattcccgtcacgtaccccgtacttggattctgagcaggcgtcatatacagccagctggttccatggcaccttaatcaggccgtcggtggtgggcgtaacttcacgctctaccacgttaaaccagaatcccgtgctgagtaacccacgacggttacgtgcgagtgcagagcgagctaatccagcgctagggttactagtgttgatgtccataacgcgagactccccaagggcttccagcgtcaggttaacagcgtctaattctctcatatttgttcctctattaaagaccccttggacctttaagacagggacaaaaaaaaaaaagcccctggcacccgaaggcaccaggggcgcgtattactcttccgcagtatcagcggctacgtcagccgccttacgggttttcttggtagccttgcggccagattcaaccgaagccacctggatgttcttagctacatcggtggcggccttaaccgcctcccgctgagctgcattggcctggagagtctccagaccgaacgtagcgattactgccattgaacctccaattaggacttggtggtgaaggtgaacttggtcactgcagcggtgtccggacgacgcaggccgatgttgtacatcgcgtagcagtccagcacgttgctgaactcacgctcatcgtcccagatacgggaggtgaacggcttagcctcaacagtcaccagggtcttggacttgctgaaagtcaccatgcggcacagcgcatcgtcagaggtgacggtgtaggcgctacccagcgggtgcgtaccggcctcggttgggaactcggtgcactcaaccacaggcacgccgttcatcttaactacacggcggtctttgtaaccgtcgttgttggatgcgccaaattccaggttcaggagcttcggatgctccagcagacgcgaataggtatcgacatccaccagggtaatcatgtccgacagcggggtcttgcgcttgatgagttcatcaataccagccttgtgggccaggttgatgttcatggcgttagcctccatctcagcctgggtcagctgtgtggcggtagtggtgccaggaaccaggatagcagcgcccacctcaataccgtcgttgaacgccggtttcaggtgcgccggagcaacccaggaacggcccttgattagctgaatcaggtgcgcctggtcgaatgtctctgcgaactcggagccgttgttctggcccatctcggtcaggaagtccggaccggtccagtcgtcctggtagtcaatcgggttacggatatacagcaccgtatccaccacgataatcatcttatcgttacggaccggggtgctatccagcgcctcaccagagcgacgacccttcaccgaggaggtgttcaggcggtcaatacggtaggtgttggaaccgctgatagagcgctggctggagaggcccaggaacagagcctggtactggaagcgggtatccacttcgttctggtacacttccaggtgaatatctacgtcagacgccgcgccgccccagtgggcccgggtcaggttgccattataaatagtgttggccatgctttagtttcctttataaataaaattaaagacctacgcgcttaccagcttcacggcgtgcgagcaaatcgttataacgttgactgaactgtggagacgccaagctacggttgcccgcttcctgacggagtttggtatattctgcgcggaattccgcagcagatagtgcattgttgctggctacaccgcgtaccattgggttctgtgtcttgataagacccatatcccggcagaagcttgccaccaactcagcggcctgcttgagctcacccgagttagcgagtgcacgagccgcgttacgaagaggttcaggggccttggaattaaacagctgcgctgctacctcccagttctccttaccgcccacgatatcgtaagcttcctgtactgccttggtggcttgaccaacctggtcttccaggtacgctttagccagcaactctgcataagcagcgtgctctccgaaacgttccttaatgaaggccgtatcgattaggttagggtcctgatactccagggccttaccaagtgcccgcaccatatcagagtcagttaacccagagactttctgcaacatagctacaccggcgtcaatcgtcgggttgcctgtcttagccagctcctggggctgctctttagcgctatcgccacccttatccagggccgcttttagggcttcgatatccagaggaatcttagcagggtcaggggaatctttgccctgttgctgctgggtaggggtctgtgcatcctgcacgccttgattgttcggggcgctaaggggagcacctaggcccggaatcttagggccgccttggttctctacctgtgtagtttctacgttctgaccgttttctacgttatccatctatgcctctgttgttaacttggtaataagcccagctgcttacctgctactgtcgggtctgctgctgtcaagccctggagttggtcctgtgctagacctgcggacgtatcggcagacgcatcctgaacctgttgcttctgctgcagctgctcttcggtgtacatgaacggctcgctaacgataccgtaggcgtcgaagtaccaatctacgcacgcatctttgttgaagcgcggagtaatctgctcaagcaccgggatagccagctgcatggattgcgccgcctctaacagcttgtccgctgccgcggctttagcgagtgcagaggtgcccaccgtaacgttgatgctcactacaccttcgctgaggtacagcttaaagcgaggatacaccagtgcggtgtacaggtacgccagcttacgcagccatgtgtcgctcagaatactgaacccgccgcccatagcggcttccgcctccttggcattctggcgaatctcgtaggccgtgacgcgctcgccctgccgggagttaccggtgtacatgaacgcacgtgacagtttctgttcgagcatctggatgttgctggcaatccactgaatcttctgggcagagccgccctcgtaagcagtgacgggggatttgctgttcccgttggaaccgccaccacccacctgcacagcctcacccgtctccgacgttgagaactcgtccacgtctaacccagagcttgcgtcaatcagcgggattaacctcgcagactcaacctcgtagttagtcaacgcttccgacagtactgataatcgggcgaagtccccggcgtagtcctctaccaagccgcgcccatagtgttcgccgctaacaaggttccacaccagcacgttgtaaggaagctccagctctggataggtgctgctgtctccgatacggtgcccgtctgcttcttggtacacctcgtagcttactacttctacgccttcctctgtccgcttaaccttgcgacaagcggcagtgtagatatcaacgtcgccgtatgggtctttgtcacggtagaaggtgccgcggaaatcttctggcaggtcctggacgcttgcgcgctctctgataatgagtcgcaggacgttcccgctgccatcccttcgaacggtaaagttacggactgagtagacgatggatttacctgtccgctcatcaatatactccaacgcgttacctgtaaccagcagcagcttcacagcttgcaacttcgcagcataaccgtctttctcaaatactttctgtgacgccgtgttctcgacctcggccagcttagattctgctgtagctgcgctgcccagcgaactaatgaactcgtccaggtccgaactcttggagaaccggaagaagctggtgccctgtgggaacagggcccctacaatcttagtggctgcagtgttgaccagctgcgcgccggtgctctgatagtctcgctccagcggcctgcgtctaccgtccagggaatcgtcccgggtaaagatcgtgctgagcgtccactgcgcgaacttctcagaggcatccaagacgcccgcgtcctggtccttcttaaagagttctgctaatgttgctttttgttccaagctacccccttacaggcccagaggattgctctgccctgcttgtcgccgtttcttctgctcagacgtaattgcatctgcagatgcagaggcagcccctgcggggtcaatctcagcaatgttatctgcggcgctattagcctctaaggcagcctgttgtttagctgcgctggcctgttgctctgccaagcgctgctgcgcctctaatcctgcgttgtcagtaaggccgagcatatccgtggccttgcctaacagtttacctaaaccaccactcattctgacctcactaaatgataagttgttttgtacgtgttactagacgtgctccggctaatggcgatacgcccagcgcgcatgcacttggctattgcgtgcaggccctgcataatcacagacactgccgcgccgttgtccggtttcaatacgaagaagtctgtatatagcacaggctctacgtaatgacagtcctctacagcctctgggtagtagctgacggcaccgactaagtcgccttgggagtcatagactcctagtatatactgtttacccagtatacttcccaacaccctccagtagtgctgctcaggagccaggccccgactaatgccgtggcccagttcgtgcagttgcttcactgcgtctgtaatatcgtcagacttatacagaaccttgagagtgtaatcggaagttttaccagtgtgttttaacttcattcctactccggtaacattaaattttagtagggtacccaaactggtataccggcctttctacataactcaaccataccagcggtaccccttccaccaggaaaggcgacgcagtattctggaaaggccaaggatatcatggcggcgttcctgcgcatacctgcagatttaccctgcacatcccacagggcaggcatacgcagaacaaaaataccggattccagggcccacctgtctgccagtgcgtccgcccctctggcatttccatgtatcactacagatggtttgtttggcagcatatccattgcggtctttagtgctaagtagtctgtgtaatctcgcccaccagttactagtactcgcataccataccctcagcagaagaagaaaggtgattccagtacctgccggatgtccagagtaccaacctctggcatatccaggtccgtcaagtccgcaccagctgctgccgccgcgcgggtgatatccccaagaaggtcatgctcttcgtagagacgcacaaactgctcgcggatgtgccggtgcatagtatcaacatcggctgcgtgtgtagccagggagtcgtgaatcggcacaatgtccagaccctcggcggcacatagaaccatcatcaagtgcgtactatccaggctgtgcacaaagttcggggcaatccccgaggctgccttgcgcttgttacaggtcttgaaatcccgattatgcacgcgcatgattgtgaggttcatacagtcaattcgtacccgcacttcttcacgctgtgtgtagcggttcattacgagcccgcccagcggcgtataccactgcaggtgctggcttgccggtacacgcctagcgaggttctgcaagtacgacataactgccgcagcagcagggtttgcctcctctatagcggcgcgcatacgcggggctaggtagcacgacagattccatagactgttagtgtcggtaccttcatacccctcagcgcaagcgccttcaaagatgtagtcactgcagctgcgcaccgtggcgctgtagaagtaggtcatactggggcgcttggtcatgctgcgggtgatttcgttctctctccagtaagtgctctggataacgaaatcctccttgtccaggtccagtatcaccttctcgtccgtacggcgcttcacatccatatacaggtccgctttcttgtcgttaccctcccagtacaggttcgtcagacgaccgcccacagggtctctcaggagcgctgagaggtgctgcccacctgagttcgtagcgtccatagctactgggattcggctaatatactcttctgggcatccagaacgaatagcattaaccaggtcgatagcggcggccaagaaacaccagggggagtccgccttggcaaaagcagggcaatcaaacggagagattgtgagttgctcaatctctgcaaagttcgcatcagcccaagctgcacggtcttcggatagggttttgtcataaccaaagcatgtagcgacgtgcactttgagccaaaataggccacgctcccccagcggcttaccacgtccgaattcaagtagggctttctgcaaatcagaaccttgggggtgcagcgaggacttgaagtacaggcggtagcgccagtccacacaagtcgggaagtacagggctttctcatctttgaattcctctgccatctccaacgtagtcagaaggctgcgtagttgcgatacgcgcttacggtcagcactgtaccacagggacatacgcgtcttccactcaccgaagcggtcaagctcttcctctgtgtagttctctttaggaaccccgtccagataccactccggtttaggctccggtactgagcgaggcatacctatcccaacacccagggcccgtgcttcttgcaccagttccagtatgcgcttattaatacggtacggggtttcctgtgccttattaagcgcctttttgatgccatccgcggatttaaatgcttccgctacttcacggagacgtgcgcggtcgatatgagaattatgataggtgccgcgattgtcgataggggtgagatatccaccatcccacagagtagtgtgctgcaccggcggtaccagcataggtggcttcatggttacggtatcagcggactctaccagtttctggaaggcctccataacgtcgtcagccggatagagcatgctcagattcccgctacagttcttccactggaacagtcccgtctcaaacactgcggcacacagcagacgccctacggagatgttctgggcattggtccaaggctcgtgcccatagtgtacgttctcggcactggcacggagcgtacgcaggatgtgcgtaggggacttcgtacggcgctctgtgagatactcatatactcggtccatgtacgctggggctacgttgcgtaactgcagagccagtagctctgactgtacgtttctgcccagtgcggacattaccgcctgtgcagtctgacggcgactggcggactcgccaggggcgacgctgaacgcctcaaacattgtgcacaggctcagggtggtcaggacatccaaggggattaagcgcaggaaccgacggtacttcccaccaatgcctggggctttgacatttcgcatctcatcgatagctgcagcagccacctcatatgcagaggtgagcatacgctgcgtcatcggcaggttcataatcccaccattctgcaatgcgtccgtaatcagcttacgtgcccgctcgattccgcgaatcttataggtctcttcaagctccagctggcgtttcaccagtgcttcctctggtactacaaccgtattcagggcgctaatcataggcgcttagtctccttggttatgtccggtacttctaactactgattgcggctgacccagagattatacatctccaggtagtctttagcggagctttcgtcgccccgctctactgctttctgccacatcccgtggcaccactcactcggccgcactatccatctgctccagttctagaataaataatgcacaacaagcggcatgcgccaggtgcggcaacccgctctccgagtccagtgtttcccccagagcatgtgccgtgaggtgccgcagtagcgcggccttgtatcgggacttaccttcggctaccgtgtgccaactgtgtgccgcatacttctgggccccgaaggtcagcacatcactgatacgcagcaacgcattcgggcacccgtccagtagcaagtccattcgaggtttgtctgcgtcatacttcatgcctgtacctactgcactcatgctaattcctccaccccgtgggattttaagtctgttcgatgtgctgctgcaccatagtcgcatacagcgtaagtggtaatacccagtccgcggaaatgctcaatcaccgcggggctgtcatcccaagccgccacaatgttttctaaccccacttggttgcgcaggaactcctctttgataatgacatcctttcggttgtcactgtgcggcctcataaccagctcggagtacataacgaagttccgctccagccaggcctctgtttccgctcgtactatatcagagcgccccgtcaagataataactcgcaaccctgctcgcaccatgatgttgcacacttcaatagtgctgtggatagggctatcatacttcgaggcccggttgaactcattccaactgtcagtcagatacaaatccacagtaggcagcaagtgcaagcggtgcgcgccatcagctagtgtaccgtccaaatcaaagattactgtcttcatttaatagcccctccccgtgctttttgtcgcgccgctctactaccctctgccacatctcatgacaccatgcactaagcgtcaatgcacttacctcggtgttgctcatacagttctgggtacttatcggacttagcaatgtcctgctccagtgtatccttgttaccggcgcagagtctgtattttaatctgttaccgagacaatagccgtagaactgctcttgcgtcatgctgcgtgcaattacctctattgcctccaggtccgggaagaactggtagtgccgaggagagttcactgagtcagaaacagcctcgctcttcgaatggaagagctggaagaactccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaacagtctcccgtgctttgcgtcgtgccctggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatacgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaacccatccgaatgggtcctccagtgcaggccacactgtacctgtcggtatatcgaaccgagccatagggccgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcccgcaggcgtcaggtacgccactgcctctgagcagccgaccaggaacatatcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcatatgcacggcgccgggacttggcgcactggcgattcaagtgataacgctgcgcactaatctcgggacccagaaggcttgccctgtatgcgtgagagttagctgcccagcgccagtcgtctgctcgcttctgcaaacgctgtgcgcgcagaagcagaaacacagcgtactgttctttggcccatgtgattatgcgcatttatacccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaaactgcgctttggcatctgctcgtttagcttctgctgtgtaggctgcactcaggagtttgataaggatgttgatgatgttcataggcttcctctaaggccccaggaggggccgtattagtttcgattagggtttattaggcttgaggtgcagcgggcgctgctggagctacaggcgctacaggagccgcaggagccactggagcagctggggctgccggcgcagcgggagccgccggtgcagaaggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgtaggctgtcccaggtctctttggttgggttgttccacaggaacagcttaatctcggaggcatccagcgctggcatcttaataggttcaccggtgttcgggtcgaacttaggaatcgggcggataccggacaggtccacgatgttcgacttcttacccgcggcgctggtgtgctcatcaatcgggaaggtgaaggcctggcccagacgctgcgctgcatgcttaatgctattgtcgtagttgagcttgtcgaagaacttcttgaagcctgctcgctcaaagttactgatagccatcgggtacgggcggatacgcttcacttcgccgttggggccgaacactacaatgccgatacgtacgttagccactgcaggcttaccggtaggcttaccacccttggtcggcaggcgcttaccgatttccacatactcggtgaagtaaccgtaatattcacccttcggcagcagcacgtcctcgtacgcaccaccctgtgcggtttcccgcatatccacatcttgggtttcgattgctgcgtctaccagagcgttcagggatgccagtacattcgtagtcatataattacgtcctcgtttagtttaaatgatatttacgtgcagatgcaggtccggcctagcgattcttaagtgcggatttaatgcctgcagccgcggctgctgccacaccgcctgccgccaggattgccaacagcaaagctacaccgccgtagaacggaagcagtacccaccaccaggaccaggcgataacgccagtcagtttcagggttacaaagataaggcccagtacagaacagattcccattttcatcgacactcctaattaggttttgattatgtcaccaacttttaaactaagagctgaggcttcatctttataccaccgctctgtctcagatttgtgcccccagcagtcatactccagggttacacgatacacctggtattgctcatcccatacaggagcatctactcgggtgacagttgaatccagtacattcatttgcttctccctacccaacgaccatcgtcgtcgagcagcatcggaattaactgcgggcaaccctcggtgattaccatcacacccaggattggtttcttgcgggtgagtctgccataagcaaaggccatgctcttgcggtcaatcaagcaccctgcatacgcaccaaagtacagcgccgttgaagaagcagcatactgaacctcgaagcgtccatgctcatgccccaacaccagagaggtgcgctcatgggatgcattgcgcatgaaatcaccgctgacttgatgctggaaacggacaggccccagcggtgtgttgagcacccaagcgtcggcccacgaccacgccggagcaccatgctcagggaataagatgtcccggtacttcttgataaattgcactggcaaaccgtgagctttagcgcggcgatatacgagtgagccgtgattggaatcgcaaaccagcaggttcgggaatagttcatgcagctcctccagtacgagcttggctttctccagctccacccctgcgctatccaggttagggtcagagtcgtggaagctgatagcgtgcccgtcggtttcgtcacccacctgcactaccatgtccgggcagtacgcatcacgtacgctctcaaggaacggcattgcgtctacgtgggtatacggagcgtgcaggtccccgacaaccagaatgcggtggcacatatccggcacctttgtattcccgatatcgtccgttgggcttggttggattagcttacgcgcctcctgcagcccgcggttggcactggccttgctgcccttgttatccatgaagatgctgcgccagtagcgtacaagctggcgagacacgattacgtcccccctgcgaaatttgttattgtacgcaatagctgcatcagtgttatttaggaaactgccaagaatttgttggtgctcttctttggtccacagtttgattagacttactttagccaaggttgcctctcttgtgttgttcctactcgtatcacattaattctcggggaatcacagaatcaagccagagtcaacaaataattttatttaattatttagttgaccctagcatatttccatgctaccctaaccccctacaccacccaagggtccacctatcactactccgcgatgagcttgtactctccagcgaagaaggtgatgccgtccccaggcttctctgagttgctgtccggattgagtagctccacctcgccgaattcaacgtcgtaagatatcacgcgatgctgcgtacccggtgcaaagtaggcacgatgtcgtgggtcgataggctccggcccaagttccagcatctccacaatactgccaggtttaatattcattctaccttctccttactgtacatgctcgtacccatttcagcttccgccgggaagggcacctcgccaatgataccgtagttaggccagagctggtggatacgcttaggtgcatcctccatgcactgcttaaccagcaggctcgcctcacgtccaacctccgggttggcgctgtccagatacaatgcatcgtgtacgttcgtaatcaggcacacctgattgtcgaaccagtcacgggccaagagtgcacgcagaaccataccagccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtacatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggcagtccctcgcggaaagcgaggcggtaacagtgcatatccgtacctgcctgtagcaagcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacagtggcacaagtattcagccggtggtgtatgataccggaaccatctgggcgttcgggtattacgtactgcagcattcccttccgctctttgacttctccgtttgcatccagaacttcccgtaaatagtaggtaccggtgtccttctcaagcgccgccagctcattcaccaacttacagaactcgaacccttggcgggccagcgcctccattgcgtctgtgctggtgctgtatactggcgtaccgtcctgcagggtgcgcgcctgtcggaactctccacgctccgcatacttctcccggataacttccggcagctcctggatgttcactaggcccgggcagaagtaaaggtcatcctcccacttaagtttctcctcctctgtatcaaggcggaatacttttggtagccccttgttcttaccggacttgtacgtggttgcacctggcggtgcgggcacgtcatccacggcaacccaagtgtccccgacttgccagtagtcggccttgacgtactggggagggtcatagggcaccttcttgcgatacttgataggcccgccgtacaccagtgcagacatatgaaagtccgagccgaagttgaaatccagagtctccggtaggtccttcgggatatactgctgcagctcctgcttaatctcacagatgcgctgctcctgctcctcctggttcttgcgcgcaattggcatattaacgaacaggccgaaccattcgcagtacgcccaagccagcaaggcatccatacgctcccacacgtactgcatctgattgcgctgggtgaacgtagcacactggccgtagaagcacagggccgtgttctttatatcaccattgactaggtaatccctgagaagaatggggtctatctgcgaggtcagaacaccctgttcccacaatatttttaccccatcaatcttatgctccccaccatactttggcgcagtttcatccaaggatgggtacatactctgaaagtcagacacaatatactccccgtgcattgtgtcgaatacgcggccgccgcgctttaggaattcctcaaagtgttgccgctgatatgttaaaaaccagctaatttcgaaggctgcgttgtgggccacgatgcaccagcaatcagaaggtatgcggaaccacagatgctccccggctacgtcgtcaaggaattcctgcttgctgttgaatctgatatcaaaggtcggttctacggtaactgtgccgtcatcctcggtccggtctatgcggtaggccgaatgcactacatagttgtcagggcagtaggggctagccttgctaccatagtaaggattattctcgacctcaaggtctatagtcataatactgctagtcatactgcaaccccgtgattatggtgataccccgccgcctcagctgccagtctacgacactctacggcttgctctatactgctaaatgaacctaattgtttatttcctagggttgctatccaacgacctctcttcctgtgcacccctacatagccgctgcggttgcttctatatagggacttgttctgcatgttcttctcaggaagcactgccctcaagttatctggggtatcttctaacctgttatgatttatgtggtctatatggtggcctgctcgcagcggaccgttgtgcatctcatatactatcaaacttcttttgtatagcttattatgcagcttaacgtaccagtatccatgtactttgttcagagttcctgcctcggaacctgcggcgcagtttaggtggctgcgtccgcgcccacttctaacctcgtgcttccagtagagtttgccgtctttgtaggtaaaccaaatatcccaattcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcggtgtcgcaccacgtaactaccgcgtataagtcctgtgtaatccgctttttggataacccctgtatagtctacttgcataaaccctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcataagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcatcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagtggcgggaacagcatgttgtaaccttcgagtgaaagttgcatagtgcctacaatagcgcagtcgttctcgcacccaaggatacgcagctcctgccatttcgcctcaaggttctggtgctcactctccatagtgccgccacggatattcgccaccatgtcgatgatgattaccgcggggcgcatctcctccatgagcgtggatatctgcgccatcgtcaatgagtgcgcagccttgacacgaatccggtcagccctgcctactttcttgaggtaggctggcacgaactcttgcttactgtgccggtccttaatctccgccagagtccaatgcagcgccgcttgatataccctcggcactgtgcgcgtcgctgggccctcgttaaccaaccagaggatagggcggtccccgtatacttccggctgctgctgcatctgctcagcaaagtccacagcaatagcagcaagcaggctagttttaccagagtccacaggagcagccactgcgatgcagtccccgccgcgtaagcctcggatgctgctagcgagttgctcgaacacgcccagtttaagaccgccgctctcgtcagtcgcggcaagtatttcatcaacacttccgctctcccattcaagcagcgaatcatgaacagcagcgccgtccccgtacttgcgctgcaagtgcttcatctccagaaggtaatcaacctcctcgccatcttggtagcgctgcgtcagcgctgctacctccccgctgtaggccagctcattcagggtctggacaatgcccaccacagaatcctgcggcacggcttgtactccccgcataagctcgtccatgattaccctctcttcccgggacaagtgccccgcccggaggttgagcatgctctgcatcgcatcccattgcacctcctggtgctccgggtaagtgttccagtacaaccccacccagtccagaaggttcgaagtgtccggcgcaagcatagacttgggtatctgctctcgcagccggttccacaccttctgcgtgcacattgcacgcacaactattagatccaattagagcctccaagttttagctttcaatacatcgtgcactgctgacacacttacaccaaggctagcagctatggccggtgtgccgtgttccctgctgtaccgcctgtaggtcttcctgatatagtccacctgctgcgctgttagcttggagtacccattctgctcccctttagaaactccacgtctagccctacccctggcaatacagtcatggacgttatccttgaccgtacctaattctaaatgctcgggattaatacatctcgggttgtcacacttatggcgcacaactagccccgctatgctctccggagatatatcgttcgccgagcaacacacctttctatgcagaggtatcttccgccctttgaacgtggtatttccgtaaccctttggtccgcctttctgtttgtgctctttacacgcgcctaataccatctaataactcctgtattgttgcctcttttgggtccccgtcgtagtagatttcgtggcacgacataaagggacgtagcgcacggcgtatcatggccgcgccggagtgtcccgcttggtcattatccatggacagtatcactgtcggtttgttctgtatcagccacgcccttaactgcacgggcaagcgagtacccagcatagctatagcctgcacgttcattgcagagtagttcgtaatcgcgtgctgatatttgatcgctgatagatagtcctcggtgagcacgacctttagaggtgcggccgcagctacagccggtgctgcggcaggtgccgcggcagcgaacggtattggctggccgtacattacccacttcggttgctgtcgggcatgcactgcacggcccagagcagcgcttccgacacggaagattatccgctgtttctctttgctccattctgcatcctccaccatttcaggcatgattccctttgtggtcaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacttgcttgcagcggtggcaatagtattcccaggcatccgggttattgtagagcaccccggcggcgtccctgccgcagcaccgaaagcgcgccctctgccccacggccaggcgcttgcacgctctaagccagggctggtccattacttctgctcgcgcttaaccgacatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccaccttgtccgggactggcggcagctcatccttcgggtcttgatatagctcgaagttataggcgtaccacgggtaggggtcggctcccccatctgtaaagttatccaactgcagccagtggccgcttgtagttatatctgtaattacgtagtaagcaaaatcccctaggtacgacttgaacgacgaagtgtttttgtgtgctttgcgaacaactttatcaccaactttaaacttagacataatcaaccctccacaatattatcgtatccgccccagtcttctacgactcgggtgcctagttcaatcagctcctgtttgaagccataatcggagaacaccatgatgtactccgccgccttctctgggttctcctgcacccagctaaccaattgctgtttagatagctgtgacacttcccggaacgcggccagtaattgcgggtcctcgtccgggggcatgtcccacggctgccgtgaactgagcgttggtgcagagagccattggtctggctccattaccttcgggtctcgctcaatcggtaggtgcgagaacgtaccatcttgcagtacccgctcaagcacttgccccaggatgttcaggtccagtacctcatccggggtgtgctcgtgcatgtaccctacacctacgttggtgcactcaggaatgataccaacgaactcggctgagtcagtgtacacccccttctgtaagtgctgctccgtgcgtcccaggcgctctgctaggatcttggcaaaggtatcagagcagcagcgcatgtaccgttggtgcgtaatgattccgtcgccgcgccggtcaaagctaatcatcgccttgaccccagtccaaaacccagtgtcatcattgaccgatgcagcgctgccttcgcagccaacctcttcatccacgaagaagcagtagcgtccgtgcacgccccgtcgcagcatctccagcatcaggtagataccggctccgcagtctgcgcctaagcagtcagcctgctgcggattctttacgaacagaacacccttgttagtgcagccgacgtccggcgcagcgctggttggacgggccaccgtatcgaggtgcgacgtaaatgccacgtcgctttgctctgagtcccccaccagcacgaagtagtttccgtgcttgtcctttacgtagtgcataccactaccaagcgcctgcataagcagcggctcgaaccacttggtacttgcccagctaggccggtgcgtttgcagtatctgcaagagcagctgcatatcaatcccgtgaggattcaagaacattaagctgcctcctctacttcttcttcatcgtcgttgcccagatacttctctcccaagcaatcggctgcatattcagtgagaattagcccgtgcactggatgttcttctgcgtgctcaataagcacctgccggtcctgtgcaaacaccagttcttcttggtcatgcactaccccttctaccgaacagtgctcaatgtccgcgtcatatacataggcgtcgtggtaatcagaccaagtgcagctccagcgattatgcagcccttctcggccaactacatatacaaagtccccatcttcgacgcagccgtcgcagaccatttcaccgtcggcggtttcgtgcatatcatcaatggagtagcgcccctcgcagcagcagcaccgagcagattcagtgcctacgtagatgtatccatcggcttcttgcgcctcgtactcgtagtcatcacggattacaaaggcgtcactgccttcttcatcaacaccgcactggctgctatcgaggtacggcatcagcaccgcaccggtgtgttgcgggtgtggtatacgcgccagcattaccccttcgagacactcagtgtttctgatgtacccatgtccgcgcaggattgcatccgcagcgttgccataagcacgaacatactcgttagtttctggcctcacgattgctcgcgcctgcacttcgaagtcgtcaccgaacagctccccggtgtactggatgaacaggcgcagcccattatccggcagcccgtgactggtagtagcgtacgcccgcacagggctatgctcaaaggagtacccgctcatgcagctacccgggccgttctcgtaggcgtcgtaccattcctgctcggtcttgcacaggtacgttttagggtctacgttcatagccttgaggtcttcgatagcatcgcggaagtccacaccatttccgtagtagttagcgagccacttacctacgcgcatctctacgcagcggtactcagtaactgcggcgaagtccttgtgcattcgaggctgccccagcatcacgatgggctcaccgttgcggaaaccaaagcccaaaggcacggcgaatctagacactacgaaaccgtgcaacttcatgagcagcgccgcggcgctcatgtcacggatgtggcgtccgtaattgtagccagtgtactcccggcgctgccgctcttctggtgcaagcataatgcgctcgaataactgcacggcctgcttgtgcaccttgtagccggtgaactcttccacgcacgcaaccacgcgctcaaccactacatcatcaccctcatagaagtcgcggcggcgttcccagaacttgctgtcgatggtgattcgcgccggagaaaggagttcgtagaaagttccggaccggtacaagtccaccttttgcaacggcccactaaccctcatcacctcgcggtattttgggtgcagtatcccgcctatagttacctctaaacccgaggtgtacatgccgacagtacgtagacccataagtgcctgcagtggaccctcattgtgagggtagtctacaccttgcatttgcaagtcctggaacggggtccagtaatcaccgctggaatacatcgaacatttaattggcagtgtgtttgcaccttccggcaacactactttccattcgataggtgctgtgacagtttctttgatagtctcttgcattttaatttgctcctgaatagattcaatgagttcgtcgttaactgccaagtcagcgcgcataccacgcagcgagctgtctttgcttataatacgagcgcacagccgccctaaatcttgtataggctccacgatatccgtaccgtagcagtgctgcaaccacatcgaacttaatgtgctcttgcaactgccgcgcggcagactctgtatactcgcggtacgtggtgagcaccaccgtagagtcctgcctacgaacacggaggagtctacgctcgaccggtatgatttgcttgagttcattaggaacctctttgaatgtttcccaagtgcagccgcacttgccctgcgtttccagcagacgccagcatagcagcgctgtttcgtctactgttagcataggcttctcttaggaacgcagtttcgtgacaccaacacaaaagccggagaggtgataacgtcacctgctcggtaactgctccgcattaatcccgcagaggttaaaagtatgcggcgctcattaattgccccctctaaagggatgagataatacagaccgctataggtctctcggtacacgtcatacttcatactacacctcgtacattaaagcgcaggcagtagcctcgcaaggtcatacccaggcgctgcgcttgcttctcgtagtgctggcgcagcgctgccttcgcgctgtactctcgcgccagtccttcgattgttggttgctgcctacacatcagcagcgtctcaggattctttccgtgcataccttacctcaaatatcgttgttgctcttaccgtccaccgtgagcgttacagcggcgtccgggtactgctcctgcaccgccgcaaggatacgcgcgcccagctctttgcaaccaccctcggggtcttcaaagaggtcatactcagggcgcggctgcggttcctgcgccgccggttgctgcaactgcactgtgcaatagggcaccgggttgtttacgtcgttgcccagcaccagcatagcgctggtcacaatgatgttgaacacgttaaccataaagttgtctccagtcgttgataatgccaagattcacggcgtccagcacagtgcgggcagccatttcggtgtaggtatccacaaattctaaaggggattcctgattagtgtctttgtcagagaatataaccacagtgtagctgtattcttcgtatatccgattgcaccacacgggccagagttcatggcccggatagaccagtattgctttcatatgaaacctcatacgccagttgcattcacatagcgccccgtaggacgctataggcttgctactaggccacttccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggccctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattacttcacatagcaccccataggatgctataggctgtaattagtgcccaaattgggagttaacagtaggccacccactaggctgtttactgccgcccttttgtttttgctttcccctcaccctgtgctcaccgctcaacccttgtttgctgggcttcacagtaagcggcacgttatcggtagggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcgaaccagcttactgcttgctatctaagttactcagtgaatcagaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactgcttggactcaatctagcttatgcccttcgcggtgtcaactctttttatcgagtgtctaacccttcgcactatctagctttaatccagcggagcctcccggctcggccccggttagcacctcagcgcctcccggtgattgaactatagacccattgaaccaaaagaagcaagcacttttttaagctttttatcaccgggagcaaaaagggtaagcagggtaaatacttagaaccacatcagggatagccctatgctggcactagctgtagccactgctagccattacgagccaatactatctaatactacaaagagcagaacgcagtggcgtaacgagagtgaagccacgtagtgatgcggtgactgtgtaggtatgtcagcctactgcgtaggcacagggacatactagggagtgcatagtgagtagtagtgtatatagtgtccctaaacccctcctactccggttacttcatttcataatagctttcgaatgaaagtaagagcaaagggatagcattgggatagcgctggatagcgctggatagcgctggagtgtgccgggtagtggaagtgcgccctagtggggagcgcgcagcgtagcatagaatcggcacaatgtaaagcactaaagatagccagtggatagcctagtgcatactagggatagcactagggatagcactacagcgcactagctggcccactaggtgccacactgtgacgcacaaaataagcaaggcagagcacgcccctatggcccacagggagcgcacagggatagccctagcgcctcatagca

SEQ ID NO: 157 - DNA, 177629 bp, Unknown
  source: /note="Description of Unknown: M16-9a Bacteriophage Sequence"
gtcttcttcaagttcatcagggaacggaacaacgatatgttcatttgtacagcggttgataacaacatctggtggaattgtatacagatattcccagatatagccgtcgcccatgtcgataccgttcgcttctccgcgtggaggttcgatcgattcgtgggtcggtgtccaaatgccaccaatacgcacacattcaactttacccgtgatactggagattgaacaagagccaatatcaggaacgtctacaacgcggtataccatccatcctttaccgtagtcagtacggttatacggcgcggagtttacaaccacgatgtcattaatgtaaaagattttggggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttacgatcggggctgtccccgatcatttcgcgaaagttcatcatgttttccgtgcggaacttaccagttacgaccgcacggtagatgttttgttgagccattatgctacctttctctgagtcggtggattcggatcgcgaggattacccgcatcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggccgtacaatgcttcaccagttacaaggtcaaatgtctggtttccgttaccgtccagacgggctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacccgtgaagttagtcttttcagacttgacaacctgcccttcaaggaagttaccgatcacgttgtgcagcgttactgaccaacgtaattgaccgtcatcatactggcgttcgatatacgtcacgtttgctctcgctgttggtgtgtaaatcgtccggcctacaatatcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttaagcagcttgttatagtaggtgttttcacccagcgaaacgaactgcaaatagtattccccgaacttctcgaaatactgctgatccagatagctttgaggcgcaaagcgcgtaatcatatggcttaaatctgggtcaatcaaaccaggtgacagatccggttgatacggtttttcgcgttcctgctgaatcagatcggcaatcaataacgtattgtctggtttccagaaaatcgttaagttatcgcgagcgcggtaactcagttcaaagaacccgatgatttcgcctgaactcttatatagcaacacgccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctataattcgcctcgttgtagtattcctgcgcaccaaatttccaaacagtcgggtcgtcgatatgagcgcgaatcgtcgcaaagttaatcgcaaggctggcagtatagccaggacgcagatcatattttacagcaccgaccagtgcagggttctcgatcaacaattcaggatcgggaagtgtgcctggatatttgtagtttgctacggaaataaaaatctccgtgccgttcgttgacatattggtgtattcatgctggatataaaaacgttctttctcggtgttcccgtacaggcgcacaaaggttttcgtgtcttctttccattgatacacaccagcagcagcggacggaaccacgttagcgggttttgtaggatcttgcagagcggttttcacttcacccgtaacgagtgcataaagaatcccgttcatcacatccattttcttgacaacgatcttattatttccagggacaactgtatagcttgctgtatcgaaaatcttttctccgaacgtaggagaactcggatcggtgtcgatcggtgtctgtttcagagcgatacgacgcacaacgtttttcgcaaccacataaagccagtcatcggaacatgccattgcttctgcatatttcgacacgttaccaggcagtttagcaaacgtgttgtatgagtctacgtcgaaatcaaggccagtctggttccccagtttggcaaacgtaacgtcatcagcagagaatcgcacatcgtccgcagaccagcgaatatccgttgaggtgcgcccgtagaagatacgatcgtaacccagtacataggttgtgtttcggctttgatacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgttctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggctggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggtccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacatatgttaacattttggacttactgaatgatttgttgaaaatttcaacgttatcagtataatatctgtcaacttcattgattacttgaccacgcaaccattcctctgattcaaccaacttactgatatcatacgttactttgatgttttgtacgatatacagatagttcgggtcaaggatcgacggcgtaatagtcgcaaggttatacttcgccagatagttttgcatgtcctctttttgaacagatgtcaagcgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgttgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatatagaaaactgttgatgcacccgttgcgtttacgatactttcgtttgtccagtcatcccattgtgcgccgttgacggtaacgcgaacctggctacggtcgatgtttggatcgcggatcaggatagtcgaaccatcaaagatgacttcggtacgtactaaacgcccctgaacgatgttcagcatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacagtaatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaaatggttaatctgagccattacaggcagtttcttgagttcagccattgccatactgtaggtgtctttcataccatcttgcaaagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgctttcagggtgttgaatagttcttgcccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtcgcatgatgttacggatagccagcaccgcagaccaaagcgggtttggtgtttcgggaggcattgaccagatctgcatcatacgcccgtacaaatccaccagagcaacgcaaccgttttggaacatagtcaaacaccagtcaaataacgcgctacaagcgtctacaaggtcgcgagcgccagccttgacatattcaacggtgtagttgtaagaactgcctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattgatcagactccatgccccacccacgatgttaaacgcagagctaatgatctgccggaacaccttcattgcggtttgccatgcttgctgtgacaatgccagagcacccgctgtgatttcttccatcccgattgaaagcccgtcaaacatcgtcgcgataccagagccatttttaattgtacccgtcagcatatcgaaagccagcttgaacgttttacgagtctcgttccacgcggaaagcatagcatcgctgatattcgtatacgggaaccccacggtcgccggaatacagcccaatccagagcgagcagaaaacaatctggcttcactcggtagcgccccatacgttgacgggagagcaggaggaaccggaggaatgctggtatctgcgttcgtgtttactgacatccctgtatatttgcactggtgtgcgggggattcgtcgtgtttcatgtacgcaatacgattaccattccagtagtaatcaatgctggtaaacgcgcctgtagtctggttgtatacctgtcggattcgctgatcgcaacgggggccggaagtcagcaagtaaccaccggagttttccaccttgtacatcgcgagttcgccagggttcttgaacagattcgcttttgatagatccgccccgtaccagtcattacccgcgagcttagtagccccgatagatgcgatataggcatcaatatccgcttgactggcgaaataataaccaatcttcgtaaccagaatgtcagtagaaacccctggggttccgtctggattcgtgggtacgtttggagagttcaccaccggaagcggatcgcttttctgtccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaaattttgcataatcccatcaatgatggtttcataatccatgatcatgtttagcctaccttcattttgcatttgtcgccatgccataacttgtaattgcctttgtcaagaacacgattacaatgaatgcaggtaactttttctttatgtttagcggcttcaatcatacgcttacgggattcttcgtcgtgtggtttccctcttctactttcggcaatctttctcttatgctcttccgaaaaagttttaccgtagtttccgttacgttctccacgaacaccatcgcctattttcttgcgatgactttgcgataaagtatgccccagcgtatgagtatttcctttcaaatgttcgctcgaaagtttacgggctgtatcatactggcgtgatgttattttcacgtcacgggtattgcacataaaccagtacgcacaccacatagatttgttgttgtgaatcttcgcaagaagataatgcgcaacaaaatgttccctgggtgaaagggcaatcaagttgccctctgaatcgtcaccacccatagatttaggaatgatatgatgtacttcaaccattccactaacaggattatttctcctgttctcgatgatttctttgtagatgcgtttataattcatacattacccaacttggactgttccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacagttgcattctgtttaacgttagccattaaattctgattcacgtttacggttgcatctttttcaacggttaattctgcgttgcctttaatcagccccaaatattcaccttcaacggtttgatttacattaccgcgaacgaactcggtcacgttaccatcaacggtctgttgaacgttacccatattataaatgaacgcatcaccctcgataacaacctgtaaattacccttaacgtttaatttacggccttgcatgacgatttgataatcatcaccaacgattttaacaacacgggttccatcagggcgaatttcttcgtatgatcctgctgggtgaacacggttgtaacgttcaaagcccggtgtatcgtcgaattcctgaatgtgtccagaacgggattcgaataccatgttgtatggatattcagcagcgtatgcggatttaggttcctcgaacattacgcgagtatcaccaggaacaaaaggatcttctgggtttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccgcgagccagtacgttgacatcattacctacataacgaggatactcaccaaacgggtcacagaagcctttctgggtgtccggcttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggtaattcctcaactggaataccgatagtttcagatttttgtttctgtgccggatgctcaccgaatacacgcacctgaacacgccccagtagacgaggatcatcgacttcttcgaccaccccctcaaagaaaggggagtatttatttccaccgtatttcataggtttgccttttccatttccttgatataatcgcttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgataaaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgctgtatacttatgcggtaaacatcgacaaatggaaagccgcgaatgcagcagcaaaacaaaagggctgggagttcaagatcatcacagaggacacattgaaacgtgtgttcggatggaaagggcaataaataccctaaacggagggaattatgagttttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgcaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctacctgccagcccatctacgttcaccacttgcagagatcgcaccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagttttccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcagatcttccgattcagcgagaaccagtttagacagaacatcgcctttgtattcttgggtaaagcgtttacccgataccagacgaggcttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatcaaggttttcttcggcctctttgtacagggaagcgcctttgaatttcagtggcttgtcaaatttcaggtcatcagcaggatcaccgctgtagaatgaaacagtgcctttcgcccagtcaatatacgctgcctgagttttgccagtggttttacctttcaggcggacaacacctttaccgaagtaagcgagatcgtgggagtccggcgcatacacatcgtaatcagcaccatgtgcaaaatgcaggaaaccaatctgaccttttgcagcgttaccacggtcaaccagatcaacggtcttagcaaattttttgttctgaacagattcagaaagtagttctttgaatgatttcatgttttcaatctcttttgaaagtataggtatgatatacctatttattgaatagatcaactaaaaattagatcgcgagcgaagcgagttccgtcaagcgaagcgaagacggatagttaacgattgtataaaaagtatacgaaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaagttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgtaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatatggacttcaattgctattcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagaaaggtttgacacctggcttgactgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccagatttgcggtcttctggaaatcgacggttcgcagggtgtatcccctgatgccctgatcggcgcgatcaaagcacttctgccagcaacagtagaaatcgctggtgataatgaagcgattgatgcatcaaaagcataattaacgcttaggcgtttaaccactgggggcgaaagcccctttttcatttggagtacacatgaaaagttttcttgaagtagcgaaacccgtagttgattcggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtggagaagtgggaaacgaaatacggtaatacgatcgtgggcgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaaccgctggatctggataagaaagtcgaagacatcacggagcacatcgaacatcgcggcgataagtgggttgtactgaaccacgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgagatctacagtgaaattcttaatagtctcgctaaacattattcgtgtaacgttctgtattacgcggtgaaagcgaaaaacgaaggtatgcaggaagtcattgcatatcgccggattaatggcaaagtgtttgcctgtgcgttcaccgtccagatgttcgaaaacatggatgattcggttgctcacgaaaagccagtgattgctttacgattccgaaccgttatccctgagtatacattgagcctgaacacgcgaaacgcgatacatgtaaattacatcgcacccaaaatcaagttcgagtatgacggctacagacgcgttatgtcacgcctggatcgcctgattgcttcaaaagattgtccgcctcaactacacatgttgaaaaatatttgaaaaaagcccttgcattcgtgcaggggcttttgttatattaggggtgtcgaaacaaaggaggcaatcatgaaactttactggctggtattctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcagtggtggattgttcctctctttcattaaaaaattctttaagtgagaaatatatgatgaagaaatttagtgtgattactcccgccgatcttcgaatccctgatttacagcaattgtgtgctgtgttcggcggcgagaaaactttgcgtcagatctccaaagaactgaaagcgaagtatccgcacgtatgccctaaatgcgaaggtaaagggtttgaagtcaaacgtgtcaacacatatccttctggcttgccggattctggatgggttgatcagatggaagatatcagttacgtttgtgatatctgtaacgggcaaggcttcactaaagaacgccttatcgcaaaacctgtcaaagtggaatatgtacccgcatgaaaaacaaaatctatgctcatatgtctgagcacacaacggttcgtgttatcttggtagatgggccaatcgctcaagtagaaaccaacgataaacctttctcgttgcctttacaaaccagtgtcggtactttcgatgaagttatcgaagaattgacaaaacatgctgttgtttatctgtgggaagcgcaaagctatccgtacccgactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgctaacacgttctggatgtacttacccgataatatcggaattcgccagcctacattcttcacgctgtgtatgttctgcgaaacctatctcccagaatgcgaggattacgaagaacattatggaaaaagtgaataaagtatccctgatattcttcgatccgaaactcggtatcacgttctgtaacggattcgcgccgaacgccgaagaaatgttcaggattgcatttagcaatgaacctgataaactcgataaagaagtgttggcagagataaacaaaactggtacgctgtattatgcccgacgcaacgacattgtgaacggcattcagtaccaatcaaccctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcaaccgaaacgcctcattgggacatcccaaaggggcatatcgaaaaaggcgaatccccgatcaatgctgctatccgtgaatgcttcgaggaaacgggcgttgtagttgaacaacacgaactgttgagcctgggtctgattgattatacgagtaaaaaagagcttgtgttattcgtatatgtgggtaataattaccccgaagcagaaaaatgtgtttgtgcttcaaccttcgttaaaaatggtcgaaccattactgaaatggatgacttcaaatatgttccgtatagccagatccgcgatcatgcgcgtaagactatggggaatttactgactaaacttgtgggatatacatcatgaaaccaaaagcaactactttccaaatctgccaaatgatccttctggctaccgcaacccgcgccgctgaacctatcgcgtatcagtcatggggtgattcattcaccgtgaaaaatattcgcgatctgcctggacgcctttacgcttcccctgatttcgaaccagtcgatccaaatgacctgactctggaagaaatgaaaaacctgggcttccgtaagtgggatgacgattcaaaaatgatgctgatccctctgtatctgttgccgtacctgaaagatggtttccgtgctatcagtatcagcggtgaagaatttgaattcagcactggtgaatcagataacgatcatcgtatggggctgctgtcattcggtgcgatgcctaatgagtcacgttgatttcaacaccttatctcaattggggttgatctggaaaatcaataaagatatcctacatcccctggggctggcgttgacgcgtgatcctgaaactggcgtatcaataggtgcgctggtttccgatgatggtgtctggtcgttcagcgaaaaatcagactttgaaaacatcgcaaagttgaataaactttatgctttacaggccgaaggaaagctgttagagttcttacaacaaaacgtgaaagagtgatatattatgacttacaaagctggcgatcgtgtagtaaccgttaaggatggtaagtttgccaaagccggaacgcacggaattgtcaataccgaccgtgatggtattctgggtgtggttgggccggatcatggaaaatcaacattattcgaaacagacaaagtgcgtatcgcaaccgctgctgatcctggttactatggaacccgcgacgagttcgaaagtgaaaaggatcaggagatcgcagaactgaaaactaaagttcataacgcgcgggtgttggctgtgatttgccttaccgttgcggctatcaatactggtttgttgggttgggtggtgaatcatgtctaaagatgatattccggttcataaccgtatccgcgatcagttaacttttcgcagtcgcgatcacgcgatcatggttgggagttatctgcattggtggaagaataaagatctggatctgaatccatcttatcagcgcccctatgtgtggacgcagaaagagcaagatgcgtttctgactaccctgatcagtggtttcccttgcggtatcatcgcgatcgcggttgatagccagttcaacgaaactcactgggtagaagtcatcgacggtaaacaacgcctgacgacgattatcaaagtctacgaaggtgaaattgggattcctatgccggacggttcccgtttgttctgggacgaaatgccacgacacgaacagcgagcctttgaaaacatttcattacctgccctggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaacattgattcagtagaaccaaatcagtttatcatcggtaaagaagatcatgaactgttacaagcggttaaaaacttgctgacctatgctcatatccgcgtaccgaatggcgataacgcaaaactggaaatcgcatgtgctggttacggttacaccgctaccgctgataaaatcattagctattcagcatccagaacccgtgaactggttcattaccgcgataaattgagtgaagaaatccatcaaactcaggtaattgtagatcagttgccagaaaaattcgattaaagtgaaaaaagcccttgcagcaatgcaagggctttgttatattacacacatcgaaacgaaacagagaaaggaaaacatcatgaacatgaacaaaaacattgccgctgtagttggttgtgaagtttctaatgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcgatcaacattgaaacggctaaactccttacccagatgttccgtaagtttcctaacaaatttccatgcaattccatgcattcaagtaactgtatcagcgtagaactggctgataagcgttgtatcagggttaacctggcttacgggttatccgaagacggatataacctggtgatgggctggacatcaatgatcggtaacttcgttgaacagaacaatattgagttcaatatgatgcgctctgatatgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgcgcgttctcatatggtgttccatatggcgacagccctacacagattaaaagctgggaagagggtctcggaaaatatctggaaaccgtagatccgcaaacggttctggatctggttagcgatctgtcactcgcgcttcgagacaagcaaaaagcagaatcagaagctgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgataaccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccacgcgatccgtgagctggcaaaacatccgatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataaggggaataacatgaaacatattttcagtaactacctgaacatcgaattcaaaactgacggcgtgaatgtctggtggtggtcaagcaatatcggtcaatggttctgttaccgccgaatccctggagcgttctgttgcaaatggaaatgctactgtaattagcacgaattgctaaaactccataaccctgatctgttattgtacacacatcgaaacgaaggaggatatcatggaaatcatctacaaaagccggaactacaaaaaagaagatattgcagcggtttacatcaagtaccggaacgtgaaatgtgagtacagcggggcatggggttatgaaatcgttgttgaagaagtcaacgccgacaacaaaaccatttgcagtttcaccactaataccgatagccctctgttcactactgaacagcttgaacaggcttatgaactgcgcaaccaggcttttaacgcggtacgtatcaaatgagattccgtccttatatcgaattccttcgcggtatcagtgagatcctgaaccgcgaaatcaaacccagtccgttagccgttgagctttaccgactggatgcaacccccgaagatgcagcgaaagattacggagatcagttataatgttaacttttgaagagtacaaagcacagcgtgatcagttaagcaactggtacagagagatcggcgcggagttaagcgcttaccctaaaaacgaaatgggtatgacgatcgaatcaatccgcaatacgccggaatacaaagcaaaacgtgctttgtgtaacaaagttttccaacagcttcgcatccttaacgggaagtacattaaactgtacaaaaaagaactggctgacgaacgtaaactgaaacggagtgtaaaatgatgcagcacgaaatcaaaacagagattgacaaacgtactttcctggaaaagaataaaacggtaacgctgatgcattactccaccaaaaacggttcgagtgagttctggcgcgttaatattgacagcaaagagaaacaccagtcgataccgttcgacaatgaaagccttgctcgcgctgtcttccaatcccacgttaaattttgagaattatattatgaaatctgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgccctcggtgctgatgcacagggacaaacaaaccctgatatgttcgatatgatggcgtatgcgcgttctaaaggcattgtgccgaaccttaccattgctgacgtatcaaaagacgttgcagcgcgtttagcggcggttgctggggctgttgcggtatcggtttataaacacgctggttttgatgtcgctttcgactcagtagcgaacctgacagaagccggacaacagcaaatcaaccttcacttcatggttagctcgaaaacctatgatgacgcgtttaacgtggttgatgccgtgaagaatgatccgcgcctgaaacaagtaaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacatcaacgaacgtggtcagttcttcccttgctcgtttaccgaacgctgggttgaaggtggctgggaagaaggtctggatgttctggaagccgaagattttgtgaaggatatctgggaacacccgaaaacaaaacagttccgtaaagaactgactggcaacaaggatcataacggttgtcgtaactgtccggcttatgcggtatgtggtaaagatatgcgcgtacacaaagcccctgaaaccgatgtatatgcagtggagttgaaataatgttaatcgtatctcgtattaaatcatatgtccgcgatcgtgatattctggacgtgtcgcttttggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgcgataacgctatccatgcgattgagcgtagaatgcagtttgcggagattacattctgatgatttatcaatcccataatgattcaacgatgcgaatggttccggtatctattgacattccagcaaaaccgcgtacactggaatcgttgattgaaaaatactctggaatggttatttgtccttctaccgcacaggtggcaatggcagaacgcgatgaaattgtatttgaatgtgatgcgaaaggctatcacaccgttgaagatatgcagatgattgaatatctctggggaatccgaaacgctgtagttcatcacatactcactgctgagaagaaagccgaagccgtgagagaagttgaacagcgcgaagagatccgctataatcggatgtctgcacaggaaaaggatgaagcatatgaagtgtaccgccgtagttgatgaattaatgagcgcgtttaaaacgcgccgtacagatgggcgtattaaagatccgaagtcaatcgcgatcatcgaacggtacgcgatgaagttaagcgaacaagaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactccgttatgtggaacctgatgcacctggatcgcctgatctgggaagtgctcgaagaagagggtattgtatgaaactcgatcgtgaattaagcatggctatccgcactattgaaatgatgcttgataaacttagcgcaaaagaagagttttgtgtaagtgatatcgaagcggatttagttgaatggcgcggtgcgctttacgaagcgacaaagggcaacgatcccctgttcgatgaatatgatgtgcatgaagttgaactctggaaccagaaataccgtttcaagtggcccaacgattcatatgatttcataaaaacactgtatacgtccggtggttatttgtatgcaaccagcgtaagtgtacatgatttgttgttatctcctgatggtgtttctttaccgaacacatttagtcatacaactgtatgtctgggtgatattggatctaaccaagtaagctggatcgaagccagcaaaactaaccttaaaagagtataaattatgtggaaaattgttgtgtgtattttgatggttgtcgttgttgtgttcttgcagtcaagctgtactgacgagaaagaggcacagcgtatcctggaagcacagggttatacgaacatccagttcacgggttacaagtggtttgcatgttctgaaaaagacacatactcaaccggattcgaagcaactggtgtgaacggcaagcagatcaaaggatctgtgtgctctggaatgtttttcaaaaatagcacaattcgtttcgaataactgttgacactaatccccgttgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagatggtaacgaagaacacggcttctatgatgctgcaatcttcgaaaccgctgaacaggcttgcgatatctggtcttacctgagcggtgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgatcgctatcgactcggacgaactgatctgcatcgagacaacgaacccagaagataagacgatcctgaaacaagcgtatgaacggatcgaagcattacacgatcgccttttcacgttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggagagtgttgaaatgacgattcgctggaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctttggaactctcgcctgttgattttggtgtacgcgaaggtctgcgcaccgtagagcaacagcgcgagaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggcgtaaaactgcgttacggtatcaactggaagaacgatccaaaccttccgattgaaacgaaatttatcgacgcaccacacgttgaacttgcataaggcgacaacatgatttcacaattctatgttgacgctgtaaagcagtcacgtaacctgcaccttgcgcgaatcattgatgggcgttgggggcaagaatgcggcggtgtgtctatcttcgaaactgcgctggatatgggccggatgtcgggtaaaaccaaagcggctttcgatatcatcaagcagtcgaaagggacactgaatatctacgttgcttgtacgaaacaaatggcgatggatgaagcaatcggaaatggtatcgatcgcggggatgataacgtgatcctcctttccaaaaaacaggatttgcggacaatctttcgtggtcagaccatcaagtatcaggcaatcaacctgattttcgatgaatgtgacacgacgatcgacgaacggtttgaactggcaaaaacgctgaccttgtgtatgcgttcaagtcatcttcacccgttcccatatatccatattatccgtttgggtatgtaattgcagtgcgcggggtgcgaatccgcgtaccccgcaattaacaggaaaacttctatgaaatatgttctagataccaacgttttaatctcgaacccatattcaatcttctcattcgttgaggcgggtactgaaatcattatcacctctgcgacaatggaagaactggatcacctgaaaagcaaagagcgaaccgctcatgaagcacgattggcgatccgcctcctgtctaaagtaatcctggggcagaagtacgaagcaattacccaaacaggggtttcgttgaacctgacgaacccagcactgccggaaagcgtgaaactccgcatcgttgattatatcggttcagaagagttcccgcttgataaacaagatgcgcgaatcattgcaacctgtatgcaggaaaacgcaaccctgatcacccgcgatattaacatgctgttgatcgcgatgtctaagggatgtcctgttgaacaatacacgggcgatgactcgctgaaagatagcgatgtgttgtattctggttatgtcgatatccctggattctgggatgatgtcgaggtgttaggatatgttggcgaagtagcccaaataagctattcctcgcttcctgacggcgattattacccgaaccaatacattctatcggatggtgaacttgtagggcgtgtagtggctgctggagagtatcagcttgaactcttaccaatcaaacacgaatccgcgatgaagcgtaagctgatgaaaacaattcagcctcgcgatgcactgcaagcgtcattcattgatgcaattatggataaaaataccgatgtggtgaccatcatgggcgctgctggttcaggtaaaacaatgctggctgttgctggtgcaatgcacctggttaacgccggacactttgcaaacctgatgtatgttaaatcggatagtcctctgtcgggcgaaatcgggttcttacctggtactctgggcgaaaaactgcgtcctgctgtagaaccatgtattacgagcctgaacattctgtttaaggatcaaccggaagttgacaaatatgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccatcatttcccgttgcggtgagaacacccttctgatactatgcgggaatattaaacagattgacaacccgcgaaacactgctgttaacaacggctttgtgtatgcggttgaaaaacttaaagagtacggtcattcaagtcatgtgatcctggataccgtatatcgtgggcgactggctgcattcgtcgaagagaacttttaatcaagggggcttcggcccctttttcgtgaggtatacatgatcagcgttattgttagtccaaagctaattaccgtttgcactaactgcaaaagtgggttagagtatgaactgtctgatgtacagaagaaaaacgaagtgttctacaacggtttcttccgtgctgctgattacatcgtgaaaaaacatatcgtctgcccgaaatgcggtagcgaagtgaaactattcttgtgaggttattatggttcaagttgtaagcattaccccaaaacaaactacctgtcgttgtggtgctgttctgtcatacactgcgcaggatgtcaaagaaaaggtatctactgattacactggcggtcgtgatgtgtatcgtgtgatccggtgtccagtctgtgataaggatgtagtagtatgaaacgcgaagaacgttatgcagtgcttaaatatgcagatattgatgcggcgttaagtgatagcgacaaactgcttctctctgcggtagtgaataaaattgatcgctatcgtaaagagcaaggcaaagaacccataaaaggggttgttgtcgagcatgattggcctgaatatgaacaggtctggaagaagatccaaactcgcgttgaccgtgaagataacaaccgcaagttcgaaacgatgctggacaacaaagaacgtctgggttatttcttcgtggttgagactcaccaggggaaattcctgatcaccagtgacgcacacagcccgaatcgtttgaaagattacagcggatacaaataccgcgccatgttcagccctgattgcgggttcgacaacagcgaaatctttacgactggctggagtgttcactttaaacatgtggttcaggtatcgtttgatgaaatcgtagaactgtacgatccgaacgtttcgatttcaaactataacattgctgaattcatcgagaaaaaactgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactccccgctgtgaagtcaactttaccgctacaacaagcaacagtaatgaagaaagcgccagccaatgcccccagctatgttaaggaattggatgatattacaccaaagcagaaaaaggttttggagtacgctttcaggatcggaaatgagtacgatcgcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtatgcacttcacgaactggaatactggcttgattaccacaaaggcgacttgaaaaaggcgctggcgagttacaacgcgggattcaagtattcaaagaaagaagcccgtgattacgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcaccctactatcatcaagccgaacatgctgcacatcattcagggtgtgttagatgaactgaacaaagatccaaaggttaaagtggaaaccatcacggtcgatcgtcatcgtatggaatcgttcagtatctacttcgcatatggagaagaaaaacgcaaactgtttatctgcgaaagtcaagatacgtatcttgatgttggcaacaacacaattcatagcggtggcgtttacttcaacctgaacgtgtggggtagcaacaaagagatcatggatatcgtgaaagtgggtattcgtaagcacgtcccgaatgacgttagcatttacgaatgtgttaatgatgcaattgaagatcgctttgtgcgcgtaggggcttaacatggaaactaaactgacaccggaacagcagttagcaattattgatgaacgtatcgacgaaatccgagcgattgtaaaaccctatcaggaaaagctgaacgggttgctgaaagcccgtcaggaggtcaaagacgagatcgatcacaaaaccgcttcccgtgtccgcgcgatgactccaaaacaacgcattgagttctacatcaattccccgaacagcggacgagagattttccatgatgcgactaagttcttccaggatatgggtctggggattgatggatataaccaagaaaccaatcagcatattctccgtatcgcgatgaatgaggatcgcagtaacctcgaaacagtcctgaaatcgcttcaacgcgtgaaaccatatgtgaaaccgatcggcggtaaactactattcgatatcttcgaacatacatgttcacagttcaacacgtattggttagcctttgacgttgcagaagaacgctggatgtgcttcacgggttggagtctgaaactcaatcaaaatccagaatttgaaagcgatagtttgcgatcagtgcttgcgtatgtctgcgaaacccattattatacccctatcgaaaacgattcatactaaggtaaaacgatgaaaaaacttgcgctgttactcactctgtttgctggctttgctcatgctgatgttcgactggctgaactctgcaaccatcgcgacattaaagacgttgcggtatgtgaacaggtaatcgctgaacaactggacgcggcttatgtatggggcgaagaaaatgcgcacctcttcaagcgtcagaagctggttaaacagcgtgagtttttgcagtctgaaccgatgatgaacctctgcaccaaagcgccaaataatgaacgttgtgaaaaactccgtacttacctggttgaagaatataacgctggtataggattatactgatgttgggattagtgatcttttatgggtgtgtgattgctgctgcaatcattatctggtattacgttaaaaagccaaacgaaagctcgttccctgtatatgatgacgagttggaagcgtggcaaagatgggacgatgaatttaaatgaacacaggttatatcttaatgtgtgttgtggttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggcgcgggtattgctaaagaagtgaagcacaaaatccctggtgcgttcaaaattgatgcactgactatgaaaggcgatcagcggaagttaggcactaactccatctacatgacggaagaaggtcagattgtcttcaatgcatacactcagtttaaattctggggtactggcccacaagtggattatgatgcaatccggtcatgctttgtgagcgcagtagaacgcgccagggcgtttcctgagaaattgcctatcattacccctcttatcggtgcggggcttgctgggggtgattggctgcgtattagcgccattattgacgagtgtacgggagattacccgatcatcgtcgttcacttcgatccatcggttgatccacgtaaggcggatttatcatgattgatcctatcaaagcaggtcgggcgatcaagaaagcgaacaaacggatcgccgcaatcaaaggacaacgcgccgcactggtgaaaacctgtgaagcgctggcgcagtccatgaaagcgaacaaaatcaacatcacacagcgtaaaacggtggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgtgcaaatcataccatgacgaaagaagagtatgatattgctatccagatgccggaaatcaaagagcatcttgcgcgacgtaacaaaaaactcatgggtaacgggtggtttacaattggctaacgcacacattatagaaaaagttcgttgtcgggattgtcatttccctttgatttgcgtcatgaacattgacaaacccccttacgacgagtgggattggtggatatactgttcaaacaaaacatgcaaaaaccatgaaggtgagggtaaattccagaatcatattaagtttgtggagcgtgtcaatggctaaactgtattatcactatgcatccatgaacgctggaaagagtgcgcgactattgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaacgttttcgatctgtgtcgcgttgttgatgaactcgaaatccctgtaatggcttacggtctgcgtactgatttccagttgaatctgttcgagggttcttactggttgctggcctgggcagacgagatccgagaactgcgcggaatgtgtcactgtggacgcaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctccatcgaacagatcgaagagacaaaagcattttcagagtattatgcacagcacggggaaagtcctgatggtttacgttggtatacaaccaactggaaacacaaatcaggttgcgcatatatccggttcgataaaaacctgaatcgcgacggtaacaaagctcatcgtgatatctccgcgatgctttcaatcgctgtgaaaaagattgattcgaaagtacgcgctaaaatgcgtcaggaattacgccggatgaaagctggcgtaattggatgggatgaaaatatcgagaacgcaaataagatccgcgcttttgagcgtagcttatgctggtatgagataacttgatgtatttttagactaattttacataaggggcgattcgccccttttttgctataaatatatacaggaacggatctattgttgatccgtaagcacgtagagaattgcttatgaacattaaacgcatatctaaagcgctgatgtttggtttgttaatcttgtctccgtcatcacatgctgatgatagatccgtagtcgccaaagagttcgattactacatcaacgcggcgctacaggtatatcttgacaccatccctcccagcgtaaataccagcgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacattttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccgaagaaaaccacactgatcgctctgggcgtaatcgccgctctgtggctggttccgaactcgtacactatcgttcaggatggtacggtaaaaactcaaaccttcatgggtaaagtttcaccgaagcctgttctgcctggtttccacctggtaaatccactggctgatttcgaggtgttcaacaccaaagacatcgcaatgaagtttgacaaattgcaggttccgtcccaggataaattcaaatccactgtggatatgaccgtgatgttacagttcgatggtagcaaagccccgatcaaccgtatcaatgcgggtagtcaggatcaggcgctggataaatatgtgactgaaaaacttctgtcaactgtccgtgagttcggtaaatctgtaccgaaagcacaggatctgtataatgcagaagttcaaagccagctacagatcgcgatccagcaggaagttgaagagtatgcccgtccttacggttacaccgtgaaacaggtattcttgcaggatatcgacctgccggaagcgatcaagaagcaggttgaaaacacgaaaattcgtgaagaacaggtgaacgcagaaaaagcagaactggcacgtaaagagcaaatcgctcaacaggcagttgttcaggcaattgccgacaaagaagcccgtagcaatgctgcacaggctaacgagcgtgatgctgatgcccgtctgtatgcggctaagaaagaagccgaagcgaacgccattctgcaacgcacaatcaccccagaaatgatccgctggaaagaacttgatgttcagcagaccatcgcggacaaatatcagggcggtgtacctcaaactgtcatgggttctgattacgctggtaaagtgattttcgattctcgtaaataaggttttaaagcccccgctcttgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcggagaagcaaagatcgtttacatccttctgggttcagcatatgcttaccctaacgttttaaacccgctgacggcgcgtgagcgtcaaaccatgatcttctcatggttaaacgctaacttcccgatcgaagatgttgttcgtgttcagtttgagcacattccagattatctttacaacgaagagaaatggaaaacctctgttcgtactgctatcagggaaaccaaaggcgacaaaatcgctatctacggttacgaaaaagatgcaggttcatactggcttaaagcgttcggatggacacacgtaccagttccacctgtccagattaacggcaaggatctatcagcaaccgatctgcgtccgattatctttaaccataaaaacgggtgggataagaaactgttgcgctttgttcctcaagcaaccgttgattatatcgacaaatggatgatggaagacacgttctggcgtttattctacgaatacgagaaatgggaaagcgaattggagaaattcaaaaactacccataccccgacgcgctaaactgttgcacgggtgatagtgtggttgtgtgcaacaatcacctgctggtaattcgtcgtaagttcgccccaggtaaagacgcgttagcccttcccggcggacacaaaaacgcaaatgaaacgttcctggattgtgcgatccgcgaactgctcgaagaggtacggatcaaggttcctgaaaaggttatccgtggttcaatccgtaattcgatgctgttcgatcatccgaagcgttccgtacacttctcaaaaccgactgtggcgcagtacatcaagttagagcctaacaatgatggaagtctgccccgcattatgggcggttctgacgatgcgttagaggcgttctggatgcccttacatgaggtcgtacaacgacaaggggaattcttcgatgaccactatcaaatcgttgtagctttcacgggactctgataaaagattaaaaaagcccttgcgttcgcgtgagggcttttgtattatatacacataccgcatgaataatgaaaaggaagaaaaatgaatacgatcaacgtttctaaagctgatgttatgaaagcaacgattattgctaccgaagccatttcattcatggctaagaaagcaggagttgatggtgctgttatcctgatggagattacaaacaacccagaaggcaacaccgcaaggtatttcaaagatcttacttcctatgcaatggaagaatttaaatgattaaacgtccttactgcctcgtaaaccgtccgatctgtgcgggtggtttacccgtcaactgctggcagttggttgaaacaggtgaagcgttcctgaataaacgcggtgataaagtattcgtctatggtgtggactcgatcgagaatgaaacgatggtgatcaccgacgagaaaacaaaagaaaaatatacgttgacttccgaccacgattgccgtaacttcaacgtgtattggaaatctaatgaagactttgaaggaattaaatcatgaaagtagcaacccttagcggtatctctgatgtaaaatgtcgtatgtcgctggaacccggtaatcgtgtaggaatcaatcatactggttctgtaggtacgaagaatttcactttgcaatctgttgcgcgtgataaaaacgatatggtttatgtgtttgttacagaaccgatgtcaaataatatccgtcaaacactggtgatgaaactgggaaccaaagatccggcaatgctgatcggtggaactgtagagcctgttactgttgcgagcgtcacacataagggcattgaatgcgccgtagacggcaacggcaaactgtcctacgaagggactaaacgccagaatgtcgatcgtccggttgttgttggtgatgtgtttacgtcagaacgccgtgaataccatgttgaatacatagcacaggatggttctctggtttgtcgcgtatactcccgtaagagcgaagacgatagcaaatacaagggattaaccgtcattgatgggcgtgattcaatcctgctggattccctgaatgttaaaattaagtttgcatactcatgattcaaacaattagcgttattatgggtgatgtcgtaaacatcaatggacacgattactacgtagcggaaatcaatacaaagggtaatcgtgagatcttggaactggacattgtaaggccgtccgaagggcaatcccttacaatcgaagtggttcataacacgaacacaggggaagacgtagtgaagccagttctggcccgtcttccggtgttctactgtgaaaagtcaaaacgttggaaaatgaaatgaatccgaaagatttaactgatgtgaaagtgggtgataccctttacgatcctggcgaaaggttatacaatacccgtaaaacagcaaaccctcgcgaatttcacgttctaaaggttgcgcgtcaatatctgtatgcatccactgataaagacgctgatttgaaaagctggaacatcgagaaagtcgatcgtaagactggattgacttctggtagtgggggctggggcggattttatatgtatcgcagcgaagcagtatacaaagaaatccagtatcgtgctgaactgagtgaaaagatccgaaaagagttcggttctcacgctgttgttgttcctgaaatcactaccgctgaactgcgcggtatcgcaaaaaccctgggggttaaattttgaaaactgtaatggaaaccgtgtttggttctcacctgtatggactgaacacaccgacaagcgataaagactataaagggatctttctcccgcacccgcgcgatattctcctggggaaagccccaaagactatcgacaccagcacgggcgataaaagctctaaaaacaccgtagacgacgttgatcgtcagttgtatagtctgactaagtttatcagccttgcgtgtgatggtgataccgtagcgctcgatatgcttcacgcttcggatgacaagctgatcgctaactctgaaatctggcagtatatccgcgctaaccgctggcgtttttacaccactgaactaactggcctgttcggttatgttcgcaagcaagccgcaaaatatggtgtgaaaggttctcgcctggctgcactgcgcgaagttgtcgatgtactgaaagaaaccgaaacgatcggtggtattcaggaattcacaccagatatgaaacgctatacgcgtgaagtgaaagtgtctgacatcaagaatcgtttccctacaaacgagttctgccgattcgttaccgacacgacaatgaaatctggttgtcaggacttctatgaagtgctggggcgtaaattccagttcacgatcaaagccgatgaaatgcgtaagtcagtgtacaaactctgggatgaatacggagaacgcgcacgacaagcagaagccaacaacggcatcgactggaaggctttaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaagctggaagaagtcatgggcgaagtcgaacggcttgcagcgatttcaacatatccgaaagaagttgaccgcgaattctggaacgatttcatcgaacgcgtataccgcgatcatgttgtggggtattacaaatgatgtatcctaaattgtccggcgctgaaattgatgttctgtataaactttacggatatgcaactaaggtgctagacttagatttcgatgacgtacccagcaaatcagggcgtgatgccctgattcaaaaaggttacgctcgaagggtaacgggctatcacgataattcgaaagcatggttgctgattaccccgctggggattgacgcataccgacatggtattaaaacggagtggcactaatgactgatattattttgaacgttaaagatgttgtactgggcgataccaaaaacccagacgcggttacactggaacaggctgttgttcagatcatgcgcgatagcctccgcctggaagttactgaacgtaccgaaagcaattacacgggcggaattgatggtcgtcagttgtacgaagatagcaaacatgttaatgtaaccctctgggcggacattgacgaaaactcatacaaaattgacgagattgattttgacgtatgaaaataattgacctctgcgcgggtgtgggcggggttcgattaggatttgataaggcattcggcggtgtcgaatgccttataacgtctgaaatcgacaagttcgcacagcaaacatatatcgaaaactggggcaatgataacctacaaggtgatctgttccagattgatgaaaacgaagtaccggatcatgatatcctgctggcggggttcccgtgtcaggcgttcagtaaagccggattgaaactgggattcgaagatgtgcgcggtacagtgttctttgaaatcctccgcattatacgcgctaaaaagccccgtgtgctgttctttgagaacgtacctgaactgctaacccatgacaaggggaagacgtttaaaacgatttacgggcttctggaggccgaaggatacaacgtattctatcaacgcctgaacacaaaggatttcggactacctcaaagacgcgaacgcgtgtttattgtctgctttctggatgacgtattcttttcgtttccggttcccccgcgcacccctacgcgagtaggcgacatcctcgaagatgctgatgattcgttcaccctgtcagataacgcatggaagggctttagagagcgtaaggaacgaaataaggcaaacggtaagggtttcggttatcaggccgtcacaagcgattctacgcacactgggactatcacccagcagtattacaaggacggcgttcaatgtctggtgttgcaggaaggaaagaaccccagaagacttactccccgtgagtgttttcgtttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgcatccagtagttgatagtggtatcttagctttaacgaaacgaaactgaaaaggaacataccatgacttttaatgacctgtttaacggatgtactggcgctggtgcgaaattcaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggcaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgcggggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaatcttttgactgggtgagtatcactgaatgcgacggctttactggcgaacgtctgcgcatagtaacactgaacaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactgatatcgacaacctgcgcgaaatgatgggtgattgcgtccctgattgtggttactacgatccgccgttgacagcggaagaagtggtcaatcacgttcatcgtgacttaggcggtcatctgggtaatagctttgaatcgttctacgacgataagcgctatgactgggaaaccgaagaaagcgcggaaaaccgttaccgttcaaatcctcaaattgcgcttgcgtatgacgggcgagactggtacgatctggacacagaagagaaagacgctctgatcaaaatgtggttgtatgaagagtacaacacgaagttcggcaatcaggacggcgtgtttatctatgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgcagaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcgcgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgttcactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagattgatttagtcggattcccttacaaaaagggtgcaatccttctcgaactggaagatcatcatttcttcgcccatgttggcaacatcgaagatcatggtgatttcgatatcgaagatatccgcgaaaagccgtatgtattcagcaactactacaaggttggcggacacctgcgcagtgataacaaaactgttctgtatctggatggtattctgtccgggatgcataattttagcatcgagaagccaggcaatagcgcagaactctaccgcttgtttgagaagtacaatcgacagaatggtaaactgttaccgtcagaaatggcttatatcatcaatcgtctgatcatgggacttcacaaaacattcctgattcactatgatggtgatgtagaacaggcgatgactactgtgattgacatcctgaaagcaaaatctcgtgaaatggataccctgccaaaatgacattattcttcatcattgcattaggtgtgtttattctgggagccacgatcgcatttatggcgttcgataaacgcgaatatcaactggcggtcatcgggcttatagtagcttgtatcccgctggtgttgtcatacaacctgtatcatgagaaaatcgcggagaacgcgaaatatgaggcaagacgatgaagattcgttctgggttcgtgagcaatagctcaagcagtagtttcattatcgggatcggacttgtccgccctggtaaagaacaggaagttgcaaagatttacggtgagtcaaacgttgaatctctgatggatatgtttgatgatactcgtcctcgctggggttcgcctcaaatacacgatgacggtacaatcacactggaagcgttcggatgtaatagcgtcgaaataacccgcatttgggacaagctgaaagaactgaatctggatgatgttaaaatcgttcacttcaatgagcgcggcgacgaaccggaatacgacgatgaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttaccgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgcagaggatactccggtcgatatgtgtcgtgaagaaatcgtgaagtacgtcaaatcttttatgcattaactcaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctggatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttacgacactatggacgaagtatacgaatatgtgcttcgtggtgaggaagtgattaagtcctataacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctgtacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagtaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtgtcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgttgcttcctttgattcggatcttgattgcgttcttaccgaacgatacgcaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatctattaaagtatcgcggatactcccgatcgtgctgtcgagaatgcgtgatgctggactggttgcgaatacaacactaaacaagttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcgcctgtctggaagtcacgaataaaccacacaggaggcgatttaataacttcaacgttcgatacgaagtcaacaatctgatccccgatactgccgttgaaatcgcttgctgtcgtctggtttgttgatggtgcaaaaacgtttgcaaccttcgaagcgctggaattatacgcttgcttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttagtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggtgatttcacaggttccggttgcttgtcaatacttgcactgctttccggtactgcggcgatcttgttctgccactggtcaagcattgagcggaatcgttcgctatcgtcttcgtcaagtttcttggagttgtttttctcttcgagtgattcaagaattttctccattgctttcttgtcttcgttggtgatattttctttatcaagaatctgatcaccacgatcgaaatcattttccgctttcggcttctcagccttttgtgctgcttcgatctgtttggtttcgtccacgcgcttacggttagcggtattctctttatcaacctcagcttttaacagtgcggggttttcctgcaatgctttcagttctttcttcttctcttcggtgatcttttcttcgatagccacacgatcgcgcatctgttccaattgcttagacaatgctttctgtgcgtctgtttgttgtccgaaactatatgagaatgcgccctgggtagccttaacctgttcgacaaccttagaacgtgcctcaaccactttatcattctgatcctggatctcctgttgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacactgtctttgatgtccagtgtattcagcgcggtttcaagggtattatcattgatatcctttaactcgcgcatcgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttattgaagaccaatcgaaggttatcaaaagtatgttcatacttagcttcgctgattttcatatcatccagattaataccgatctctttcagtatcgccattgctttatcgtcattgtgataatgcaggtgaatcaaaaggaattcggtttctgctgcggttaattcgcgcggttgaatctctttgatgatatactcaagcaactgcattgggtctttcattgctttaatctgggtgaaatgacgatagcccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacagaaacgcggtatatgagaacaacttccagaacccagacaaacagggtcaaccgttccaggctgtgaagtgtcagacgttatccagctatgaaaaacgtattcggtttgatatcaatcagggtcgaatggatgttaaagtgggggcattgattgaggtgttaggggatgaatattcagggaagtatctgatcgttgaatgtgtccgcgacgtatcaaaagatttccacctgcaaacattggaatgtgtacaggtggcagcggctactaacgacaccagcaaaacaagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcaaacagttcatcttcggtgtattccttgtttttgtccagatcgagaatgacgcattgccaggtgtcttcatcgctggtttgttgcatcatcaccagtgcggcgtttttgaatcccagattatgcgcaagcatttcatggacgaattcgcggtcgtcgtcttcataacggatttcttgcccttcccaacggatcaggcggatagttttacttggttcatttttcataacgtggtttcctgctcataagttcgcgtaaacgtttcgtcggttcaggtgggtttttgatgatctcttgaatccgatcccacacttccggtgaaacttctttcctgtccatgataacgatattctgattatcacagcactttccaaccattacggatcgcccacaattaaggcaaatcgtatcagggcattttccaagtttatcagggtcgatagattcaaggaatcttcttgctaccgataaccgctctttaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaaaccagttttcgcacagcaccagcgatgattagggtcttcgctgatagtttcgaatatttcgagtttcttactcatttcaggtcaccgataatttccatcgctgcttcgatgttttcaacaccataaaaggtattcccacttacttcaaggagtttgataccatgaagataaaccccaaccagcgcaccgatagcatcgtggatagcgtagttgccgttttgaagttgatttgcagtgtgcataattttcatgatgtttctcctttcgtttcgatatgggtaatgtaccactacattacccagtaagcaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacacgcatcacgcgcattttagaaaggctttcgagtgcgtctgctggcagtttttcaccaccgttacccagttgtgccaaacggtcttcatttaccagaacgattactttgccttcgagttctttagtgatttgcatgggatgttccttttgtctgtttcgtttcgatgtttgtaatataacaaaagccccttactcatgcaaggggctttttagcaaaaagtgctatttaaaacagatcagcgaagataacgtgaatatcatccggttcggtcttatcgcgtcggatcttcttgatgattggcaagaagaaactgaactcaggttcgcccttcttacgcgttttagacttctggagtccgtcaacttccatttcgacgatagcgccgatatagtcatctttgttcgccatgatgtattcgcgatccagttcaccacgttcttctaacgggatgtacacgcggttaataccgtcttcatcgtatcggtagtccgtatcagtcagaccggaacctgtgtttgttctggcttctcctgataagtcctcaaccacgaaccctccgaccttatgagcttctttggtgtgttcgtacacgtcgatgattcgcagttcaatcggggttttgttcttcaacttcacctgatccgcaacgcgtgaatccttccatttgaaatcaacgtttttcaggattgaaccctctttaccgtcattgcggtaattgttgtaatcctttttcgcttccgcgtagttctgcaccaggatagaagggatcaacttaaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaccaaaccttcatactcatttcccgcgcgggttgctttgcggatctgattctctaacagatcggacatacaacgcgcaccatcggctttaagctgcgagtaagcagggaagcgaatacgttttaaggctttctcactaaacggcgtagcgaggcattgaggctgttctggaatgagtttcttccatacgcggttcggtaacgttgtaccagcaccacattccagatcgcggttaatgatacggcgaagcacttcgcgatcattctcgttcaccgatgatacgatatccagcagacgatcacgggctgcgttgcccgtatattttcgcgttgccaaatcagacatcaaatccgcgatagcattcgatagcggggttgtgcctggcttaccgtccacctgcggaaacttcttaatgtgaaacataatctgtttcgtgtacgtaatgcggaaaatctctttcagcagatcattacctgcattacgtttcaggatcgcttccttctctgagattttcagagtcgaagcgagttcatttagaatctgtaagatcatttaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattgccatatttggctttcgcttccaggtagcggtgtactttggtttcaccatgcccgacaaccatcacttctttgaatgcagaagggaacagcgtgttcaggtttgcaatacggttaaggcttgccgtaggagtggttcccagcgccgtgacagccacgaaatcatatttgactttcagacggttgatcacaatcaacgcatcgtcatacgcgcttagatagcgaataaacgaactgttattgtattcttccatgaggattttagccagttggtgatcacacccaaagatttcggtcatatcacggaacttttcatccgtaaccatatccagcgcgatatcggtcggcatgttgtgttttgacaaaaagaacgggaggccgctttgccattttacggcgatcccgtcaatgtcggtaagaataactggtttcaagatttaacctcataacgatcaaagaaaagggtactcttaaacgcttcaatatccgcaaggaatttgtcacgctcaaatgtacgataataatcaaattcgatacacagcatatcatcgttcgtgacactgataccagtgatatcttgatgatatttctttgcttgttgcagaacgaacggatcaagatccgaacaatcgaaataaaccacgtaacccatcatcaacccttgtacatataaacagcgtcgaagccaggaacatccatttcgactttatcgaacacaatatctttcagcttacatttttcaacgtagctgttgatcacgttaatgttgttcgcgccgatggtaacgtaatacacacccgctttgtagataacaccaataatcagggtagaactcaaagcaccctgtgcgtggagtaatgccaacgggttaatcgcgcctttgaacaggaacgcgcattctactctttcatcataatctttataacctatcataacagatctctcaatcgggttaaatttcggacaaactcacgttcagtgagcacagtttcattcatcttattctttcccattgaatgagtcaaggtactttttccggttgcagccagcgcacggcggaacccgtcattcaggaaaagagcattgtacgcgttttcaatcaggatttgatacgcttctgattcacggtgaatcggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatgggtatgaatcaccactaccaatattcataataactctcttaacgtatggtctacatagaaattcattgattacatcaatctcttcggagattgttctttctgttttccccgtataccttcatacaccgactcgattaaaagatctttttcgaatgaccgtaacattatgaacaccacccgccccgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtattcttaccagcagccagaacatacgcacgggcttcacgacgagtgttgaagcaaaccagttctttcatgttgtaagttttcataatgtcatcctcagtttcgtttcgatgtgtgtactttaccacactcacgattcagcgcaagcattattttgcataaaaacaaaaaagccgctacctttcggcaacggcttgatttttaatacttttcttcgggctggaacaccgcacgacacgcccacatagaggcttctttcagtcggtctttcgccttttggatttgatggatacgttcaagcatcgcatcgagttcttctgtagtgaatgaattggtatctgataccgcgtaatcacttgaatactcttcatccagttctttgaagatttcgcccagggcaacttctgcggccttgatgcggtttactttgtcgatcttttctttcgaatggggcttatagccctgtacgtcttcaatcgccattatagactctctgtaaaggttcgggcgataacgtcgcgctgttgttcaggagtcagtgaattgaaacgcactgcatagccggacacacggatcgttaactgcgggtatttttctggatgcttcacagcatcttccagagtttcgcggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaacacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggcttgaagacataaagcccccatgccgaatcattccacatcaacagataaccgtgacgcgaaggatcggaaccaccttctgttttcgggttgcccttccaggcgaagtctgattgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacaccagaaagaatatcaaggggaaccagtacaaaccagcttgcgtattttaaaaagcgcatgtgcttctccagaaaaaaggctatccgaagatagcctgttgattaacgaactgctttgatatacttatacgcttctgcgaattcttcttccagagcttcgttgcagaacggaataccttctgctttaaatccaccagtaataagatactggataaagaacacagaagaatccatagagatcaactgatggttcgtaggttcgatatcagttcgacgaacgatattgacgatcgaccagtcaaagaatcgtcgatgatattcatgtttgctattcacctgcggtgatgcaaagaaaccatcaacagaatacgcatcgaacgctttacgatattctttatcgaaatcagtgatttcttcggtaaacagtttcatcaatttaccgttgatttctttttcagttgatgcagcgacgatttcgcgaatttttggggttaactcaaacagcttttggagacctttcatattttttctcttttaaatttgtgggctggaagtttctttacttcaccccgcattccggggaacctattaccggataccaacagagccttctccgtgagaaaggttgcatattccgaaccatttaacggcattgcgctacgcacccgaattggagcaggtaaagggactcgaaccctcaacattctggatggaagccagatattctaccaattgaactatacctgcgtatttggtggcccctactggactcgaaccagtaaccacgcgattatgagtcgctcgctctaacctattgagctaaagggccggaatttttagaactgcttgcgataaatttcgcgaaccagcgggtcaacatctttcgcgtatttacatacgtcttcgaactggacgatgtacgccatgacttcatcggcacgggatttcagtttaccctgatgcgcgtcaatgatcattgctgccattacgtcaatacgcgcgggggcttccagaatttcgcctttgtcgaacagttttttggacttgctgacagtatcagcgataattgcttgaattgatttagccatttttagatctcgtagattgcctggattgctttgtaatgtgcggaaacgtatttcgtttccttctcttttgcttctttttcggaaatgtaacccgcaaccagatcagggtcaggaacattcgccatgtgagcgcttggcagcgggatatatttacccaggatacgttctgccacttcttctggaacatctgcgcctacagaaacaactttaccatagaaaggttgttccccgtgctggcgtacaccaaccacgatgccagattcagatttgatttcggaaccctgcggacgcgcagtagcttcgatgatcacatattcgccggatgcttttactttcagttcagacatttctttactcattgttgttaaacactaatctggaaaagttaacatgaggttctaactcttcccgtttaatttgttccacgatacagccatatttctgtaagcgtgaaatccattcatcattaccacgatcgtatttatcgaggtaatacaccgctttgatagcgcctattgccgcataccattcgatatgttttgcgcagtttggacacggcgaagcggttgtgtacaactctgcgttgttaagcataataccattagtatgcgcacttagcaacgctttcatttcagcgtggatctcattatcgtttgaccatgctgaatgctcaggacggtgaaccgctttcagtttaccttcgtcattcagcatatgctcgttatgatcagcacaacggcaatcagaatcaaccgtattattcgaaccctgcgaaaccacacgcccgttcattactataaccgcaccaacacgggtcgatatgcatcgagaagcctggctgtgttgaatagcacggatcatgtgaagtagtttcatcggtcatccatatatttcagaatgtctttgatgaaatcgttatcagggttaacgatgtgatacgtagtacctgaacgtgtcactacttcaacaaacgatttgttcgacggaatcgcatattcaacaaccggacttgttgcaatgtcctgttgaggatcattatcaaccaacccaaacacacaaccataacgaagcatcgttggttcagtacataaccatgcctgatgaatctttctgattttgtcgctcataatacccccgcccatgttacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtgaatatcgtgacgatgatcaccttcttcgcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgataaccttcgtgaagtcatacgggctacgttgtccaactttggttaatgtcccgtcaacgtcgaagataacgcatttcggtttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacaataaagggttttgcggatatcgtcacgggaaacagtcagagtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatctgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattcaccggattcaccttagcggggagcgtaggcaaaatcttttctgggggcttctcagcacacccgaccaacagaacgcccagaacaagggctaacgttgcaattttcatttgtcgtactccgccatatactcttcgaaggacttgttgatcttgatttcgatcagtcctggtttcttgaacagcagatctttacgtccggcatccttgaccaactgctgatccttcgctttctgttcgacatagatcaccgtattggtgttgtttgtctctttgacttttttgatatcagcctgtaactctttgatatctttagccaattgatcgttttcacttttcagcgtgattgtcatgtacaaaagccctgctaacgaaccagcaactattacaggccatatccacgaacttatattaaacgtacccaatacgtttttgatattcatataacgcttcctcgtaagctattgatgcttgttcctcggtatcatagtaaccgatgtgtttttgcttcccgtctatctttatctgtgctcgatattttccacgcgaagccctgtaatcaacacctttggatttaaccgttttaggtgttgatttagcttttcttttcagcatattatgaagcggatctgattcctgtagattttctataccatccccagcttccaacccatgcttatgatcaataagcaaaggcagataaccattacagtaatagaaaattatgcgatgtcttaaatattttctatcgccgtgccgaattctcacgtaaggttttgatttgctcataatagaaccagcttcttttccctgattctgttttgctgcattgttattccaaaaaatttttccggtttctgggaaaacgtcaacgtaaagaagcagggaatcgatccctgctttctcttcttctaacgttgtgcttccagcgccaaagcactttgtcatttatattcttccggtataaactgttcgtagttcttcgccattaatgcaacgatgttatcaaccagcttttgcttatcggtatcatcgaaataacgcatcataggcccgaagatgatacgaccgtcaggggttaagtcagcgctcagggcgatcgcgtagtctttgcgtgattttcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgattacgtaaccctcgaaaccttctttcgtgtaggcttcggtaatgaatgcatccagatcggtgatttcgattttctcgcgctcaaccaggaacggacgtaatacaccatctgcgaagatatcctgataatcaacatattcgcccgtgtcgttattacggatgttcaggatcaccactgctggttcctgatagccaattacaatacggtttgtcggtgcgacgtattccatgttgacggtgaaaccatcgttaaccagttcggtcaggcggtcgaacaatgcgcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggctttcagcgcttcccatgcctttacctcggcatagttgaaaaacttctccatagggcgactggcgagttttacgggggtttccccatccattgcaaacataatgccgcgacattccagcgcaccaggtttcaaccaatcgctgtaacttgccatacgatagttgaaaatgcgaacgtgggtttgcattacggttttttggtcaataaagtaaaagcattcggtttcgttacacaacttcattaattggttgaagagtgttttctggtttttggttagctttgtcatagtgctgtttattccattcaggattaatttttcggatcatgtttatttcaaaattatgatatgtgttttcgtcgtgtgttgtcacaatgagattcacacgcttacgttttttgattgccatttccagacgtgcggttttcaaaatgttgctggggtttgcttccctccagtattttgaattcctgtacgtatctaatcgcttccacatgtcttttgctttaccaacatacacgatcacgccgtcgatttcaatacagtaaacgcaatttcttaactcaccacacttgataaaactgcggtctattcgaccgcatttgtcaagagacattctataaactttcgattccatcattcgtttctcatgatacccaaccgatgcaacttatgacttattgaatcggtagaacgattcattttaatccctatcgctgggttgttgtaaccctccgaatgtaaacgaattagttcggatatttcttccggcttccaatactttcgtttacttcctttcatatcattatcggatgaacttgcattaagatctgaatgtttacacaaattaaaatatgcgtcaactgctttttgctttttaaatcgaaggtatggaatgattctcggtaacagaatcaagagatccgatgatttttgaataattaggttgcacatcaacgtattacctaatcctgttctactggttctttcatataattttgcatcaacaccatcgttaatcaaatcagattgaatgctaaccatatcatcccatagttgaatatgctgtgtaagcccaaccagataaccattctttcctttttcactaatccatccatcacaatcaacacaacccgccaggtatgcgtatagattgtgatggactcccgtataaacgggaatcgcatcaatcatgttatgtccttacgcgtatttttgtcgccattttgcataggcttcgtcgctgatctcggtgttgaggttgccaaccaggtaagaactcacttctacttcctgtggggctacctgtacgttgtcagacttcaaccatttgttcatccacggatacgggttcggcgttggtttaaatggagactgcaagccaaccgcgcgcatacgctgatctgtcaggtgttcgatataggcgatcgtacttttcagggatacgccgtctacatcaccgatagagaaaaggtgttcagcccattctttttcctgttcatatacttccaggaaaatctttgtcgcttcctcttcgtactggtaagcgatttccgccatttctgggtcatctttacccatctgccagagtcggatcttgctttgagtgcctttctgatgaagtgcttcatcacgggcaatcagacgcatgatctttgcgttaccttccatcttgccttgttcggcaaagttgaacgtgaaggtaaacgacacatagaagcggatcgcttccagagcgttgacagcgtgcatacacagatacagagcgattttgcatttacgcatttgctctttgcgtttcttctcgtactctgcgatcgattcgtctggatatccgtgggacgttaacatttcgattttgagcacaatgtttttcagttcgtgacattctgcgatcagatcatcgtagtattttgtcatggaagccgaacgtttcatgatcgcttcgttgcgcagaattttatcgaactctttcgacgggtcgatgtgtaggttgcgctgaatgtgcgtataactgcggctatggattgtttcactgaacgcccatgtttcgatccacgtttccattgagacatcggaagcgatagggaggaacgccaggttcgggccgcgcccctgaatggtatccagcagggtttgatattgcaggttcgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattttggtttggtactacctgattgaatgaaccttctttcgaagatttcacactcacagggccgcgcggaggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcatatgcttcggagtagtcgcaatagttgcttgccagccaggatgcatagttggtgataccaacacccagagaacgacgctgtttagctttcagagccgctgcaacagggtagttctggtaatcaagcaagttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacagcacaggttcgacatacgaacaggaacagagaaactaccctgctggtttacgtgatgactgttgaaaatgtagttgcgtccggtctgtgcgcgttcctgaacaagcaactggaacagatctaccgctttgatgcgtttcttgcgtaccgttgggtctttttccagactggtatacagttcttcaaactcagtctgatccgcttgatagaacgcgtcatacaggcgatcgttcgcaacgtcagggctgaacagagtgatgtaatcgttattgattaagcgcttatacatcaaatcgttaagctgtacgccataatccaggtgacgaatacggttttcttcaacgccacggttatttttcagaaccagcaggttttcaacttcaagatgccagatcggataatacagggttgcagcaccaccacgaacaccaccctgggaacaggatttaaccgccgtctgaatgtgtttccagaacgggataacgcctgtatgtactgcttcaccaccacggattttagaacccatagcgcgaatgtgtccggcgttgacaccaatacccgcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcacgttatagaagtcaacaacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgaaaattcaaaatctttatcgtgattgattttcgattccagataatcaatctccgctggagtccattttgtcaggatttctttatcgtattttccagcctcaaccagcttagtgatgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccaccagtccaaaccagatcgccaacttcatacccgcaaatatcagcgataatatgcgtcaggagagcgtaggaggcgatattgaacggcaaccctaagaagacatcaactgaacgctgataccactgtagagacagtttgccgttgattacgacgaactggaagaaacagtgacacggacgcaaagccatatcatccagatccatcgggttccaggcagaaacgatgatcccgcgatcgtctggggttgatttcagttgttcgatgattttcttaatctgatcaacaccatcataaaacccttcctcaccaaacgaacgccattgatgtccgtagatcggccccagataaccatgcgtataacccagcgctttagcctgattttcgtagttatcgtcccagatcgtccgcttatcgctatcttcaccccacgtcattttacgcagtgtttccacgttggtagaaccagacaggaaccattgtaattcatgcttacacggtttgaagaatagctgtttgctggtagtcgctgggaaaccttctgcgaggttccaacgtgcttgcatcccgaagatgcgcagtgtaccaacaccagtacgatcggttgattccgtaccgtgtgttagaactgtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggcgcattgaaagtgtgatgtccgtaaatgtgcgtcacaaccacttcgtcaaccagtgtattattgattgcttccagaagcaaccccttaccgccaatgagacacacatcacgatctggatgcgtttctttcattacgtcgattgcagcagacaacccgccgccgtggatgacgtaatcagcaacatcgccttttttggttttgaggaaactaccagaaccagacataacgcagtgaattcgtcctggcaatttaccaggaagagaagtaaaagtgttcgcacccatgatcaggacgctatctgcggtttctgctttgaagttctgcaaatcctctttgcagtggccccacggtaaaccctgttcataaccaaacgcatagtccacttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaatccgttaacatgcgcgttaatgattttggattccagatcgaaaaccatcacatctaacggactccattcaaccgaatgaagtttttcgcgggttaacagggttgtgtgttttggtagtttcattggggtacagtttgccatagccattgttccattttgcgtaaatcttcctctaacggagtgaaaccaaaggattcttcgatcacaccgtcttcccatacatcaatttccagaatttccgttaccggagggtttgacatcacatgatcacgacatgcagccatagcggtcataatggaatttgttactgtcagagtgttgccctgaaccgatacctgaataatcatactcacctcataaaaaagggaactgcttttcaacagttcccattatagcataaccagttagtgtttcaagcgccaaagagcgattgcttcatcaactgcttttttgatttcttccggtgtgtctttgcgtccggctttaaccagggcagagagcatagaacgaatggttgcattcatctgtgatttctcacgatccatctgtgcctgatgcgccttatcaaccgctggggattctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccaacaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcctgtttcagtgcgttgaaatagtcatctttattgatgcggttaacggtgcgttttggtttctcttccggcgctggcgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccaaacacgcgccgtcttcgtcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtatgaccgcgaacttcgctgattgactgagtataggttgttggttgtccggtgaatttcgtgaagtattccgcgaactcttgcgcgttgaatttcgtgctgaaatagtttttcgcaaccacgaaatacgctgcaaatttttcttcccatgcttttttgtttgctgcgtgttctgcgcgaacatcactgtaagttttaccagcgctgtttgttttggttacaacgtcatacgcctggttgattttctgcatgagttcagtgctaccaccacgatcggggtgattgcgcagagaagcacgtttaaagagttttgacagttcagctttagattcgtcgccagtagcgcccaaaatcttcaatgcttcgctgtgtgacatttgttcgttaatcattttccgttcctcaaaataaaagcccatgtaactcagtacacgggcaactttaaggtatttatgttttgctgtcaatagattttttcgaggaaccacaccgaagatttattgttcttgatgcgggtcaattcaatggggttatccttgaatgcttcctcaacatctgccattgtaactacatgtttcgtttcgtgtaactcgttgtggagataaaacctctcaatttctggggttgttatcagttcaaactctctttctaacataatcatgttcctaaataggggtatctagcggactatcaaacaggatttatcatcatgaattatcataagatttacgaacaactcatgactaccggaacggatgcagaatacaaagagaaacatcacatcgttccaaaatgtatgggaggatcggacgatcccgaaaatctggttgaactgtcagcacgtcaacacttcatagcacatctgctattagttaagatgtatccaggcaaccataaactaatttatgctgctaacatgcttacagtcggtacttctcgatcgtctgcgcgtacagcaaaccgccgctatggatggttgaaagagaaagcacttgaagcccagaaacaaaaagagttcagcgaagagacacgcttacgcatgagacaggccaaacttcaacagaacagggttacgtgtcctcattgcaatacgtccggcttagtaggtaatatgaaccgctggcacttcgacaactgcaagcacaagccaggcaatgaagggaaagtgaatgcatttgcaggagtcatgcgagcacataaaaacagcaacgtagtatcggagcgcggttcttgtcctcattgcggtacagaatcgacagtgcattacttgaacagtcatattccatattgtactcagaacccagacagaaaaacacaaaagaaaagggagcaattaacttgcccccattgcgctaaagttggtgatgccaccaatatgaaacgatggcattttgacaactgcaagtttaagacttcttgatttccatcttcgagaatcgaccgaccttcgacataacgatgtgtcggtcaaaatcttctggatctaaatcctgatgacttatcacaatcaaattcccgttaacaccatcaagcaatccttttacagcaaaagagccgtctttgtcaagggggccgtcgaaacattcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagtgtacctttcagggcttcatatttggttttcagggcattgagtgcgcgttgctgttgaagcaagtcattcatgatcccttgtaactcgtcctgtttggttttgatcagggttaaacgctgtgtacccgctttgatgttctctgcgatctccgccatacgctcaggagtgggtttaatcgcttgcttacaggccggacactcaccgcctttctgatacatcacctccagctttttaaactgttctacagtcattgagagccgagaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtaacccgctgtacccagaacgataacctgtttgaagcccacaaggttgatgttcagcatagattcaagctgtgcctgataatcacccgctgcggagtcttccggcaacttctcgccgttcttccagatctcgaataccttcggcttttgtccgcgcaccactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttctttgccgtatcaaattccagttcgatcggggtgttcccaaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattttccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatattgatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattgacaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgtatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgtgctttgcgtagggcttcctgttcaatgcgtgtacccttgatggattccagttcttcttcacgaagatccagcgctgatttttggtgtacttcgtcgattacttcatgctgcacgttcatagtaggtgatctccatgatcattgtttcggcgtttattacatagtccagacgaccttctgctatctggaagtctggatctcgtacatctgtagggtcgatgataatcggaaccccgacgttctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcatcaaagttatgaaggccggaaatcgttgccgaaattccatcgtcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaattggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatctgattgggactgggatcgcctgaatggtttccttcacccgacatacgatgaaatccgtgctaatttaccgtacaaaggtatccgcgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgatacagagaaaacgaagaacttcgcgactttgattttattccgaaagatgttgcaacggcaatcgaagaagcgtataatgctccaaaaatcgggaacaaagcaaaaatggagaaatacttcatggaatgcaaactcacccgtatgtatgaaaaactaagtgacttttgaggtaacaaaatgagtgtagaattactgcaagaaaacccagacatcgctaaagcggttaaagaactgatcaaagaagcgtcgaacgtgaaaactcagatcgaacatttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaacaagcgttccaaaagagaaaggatagatattttttcgcaaagttagccgaaaggtttacattcaaagaaatatatcttatactactctgcaatatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttaagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcctccggcttccagaaagatgaaaaagagtggaaactcactctggatgcacagaaaaacggttctgcgactattcgcttcctgcctaaccgctctgatgacgaactggcgtttgttcgcctggtgaatcactcgttcaaaaagaacaatcagtggttcattgaaaactgtccgtctacccacggcgattatgatggttgtcctgtatgtcagtatatctctgacaacgatctgttcgaaaaagccaaagccaataaaggcggcgaagctgataaactgctgggtatgattgggcgtaaacaatccttctgggctaacattctggtcgttaaagatccgaaagcgccggaaaacgaaggtaaagtgtttaagttccgtttcggcaagaaaatcatggataagatcaccgctgctatcgctggcaaccctgatctggatgaaccaggtatcgctgtaacttgtccgtttggtggtgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccagtccaaaggtgctaaagaatctggtggcgtaagtcaactgaacgtaggcggaagcgtaccggaagatgacaacacccctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcaacgagtccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccgtctgtaatgctgaaaaagggttcgttcattatgacgaaatccatcaacagcgtagtttacgcagaagcaacaatttctgacgtaattgacgaagatgtaggtatctacgatctgaactcattcctgaacatgctgaacgttgtaggcactgatgccgaagtaactcacgacctgtccactggcgaaatcgtcattcgtggcgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagtcagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcattaccgcgaacaacatcaacgggattcaccctgcgctgatctcccgctgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatcatcaaagctattgaatccggtgatcacttgatcaaccgtctgcatagcgaagacatcaaactgtctcttacttgcaatctctctgatctgcgcacctacgcatacgcgcgggatcacttccctaagttctatacccgcatcatggaagaatataccgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaggaagcaaaaaactggatgcagcgaatgaaagatgtaggcatggaagcgctaggcatggatgatttcaggctggcgtatatctccgattcctacagaaaggaaatcgaatacgatcgcgacaagatccgcattgcttcacttgatatcgaagttaccgcgcctgaattccctgatccacgcgaagcaaaatatgctatcgacgcaatcacccactatgacagcgttgaagataaattctttgtgtatgatctggtcgagggcgggttagacgagtgggtagcgtcgaaagttgataccgaaaaagagatcagcgaagaagatttgaagaaaattgtttaccgttcattccagaccgaaaagtcgctgatgtcggcttatatcaaagactggaaagagcggacacctgttattgttacgggctggaactcgaacaaattcgatatcgcgtatatcatcacccgttacctgaacatcttcgggcaaaacgttgttcgtcatttcagcccgttcgggaaagtgactgcgaagacaacaaccgaccattatgggaatgaacaactgggatacgagatttacggcgtttctcaaatggatggaatggatctctataagaaattcagtttcaccccgcaaccgtcttacgctctgggcgcaatcgctgagttcgaaacaggcaaaaacaaagttgattacgaaggttcactgtctgaactgcgtcaagcggatcaccagaaatacatcacgtataacatcgttgacgttatccgcgtgttggatatcgacgggaaacgcaactttatcgaactggttctgtctgtagcgtactatgcgaaaataaacttccctggggttatgtctccgcttaaaacgtgggacgcgatcatttacaactctctgcgtgaagagaagaaagtaatcccagaaaataaacgccacacgaaaacgcagtatgatggtgcatacgttaaagatcctgttgtcgctccataccgttacattgtatcgttcgacttaaccagtctgtatccatctatcatccgacaggtgaatataagccctgagacaatcgctaacagctttgcagtgcgtccgatgcacgaatacatcaataagactgcgccgcgccctagcgatgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaacttgaacacctgacggacgcgcacaatcaaatgatcaaccctgatttcgagttctacgaagatttcagtgatgaatcaaaagctgtactgaaaacgctgtctaagcaaatgcttaaagccgtgaagaaagtttgtgagaagaagatcgcacaagcaaacaccgcacagcttaaccgtaaaatcagtatcaactccctttatggtgcgttgggtaatgaacacttccggtacttcgatattcgaaacgcaagcgcgatcaccatgttcggtcagttggctattcagtggattgaacgtaaggttaacgaataccttaacgaactgtgcaacaccacggattacgcatacgtgcgctactgtgacaccgactccatttatgtttgtatggataacgtgatcgcgaaagtcggcggtgaaagcaagttcagggataacaaccattgggttgatttcctggataagttcagtaaagaacgcatggaacctatcattgataagggctaccgcgaactgtgtgagtacatgaacaacgtcgaacatctgatgtttatggatcgcgaaatcatttctgggccaccactgggatcgaaaggtctgggtagtttctggacggcaaagaaacgatatgcggctaacgtgtgggactccgaaggaacccgttacgagaagcctaaattaaagatcatgggaatggaaacccagcgcagtagtacaccgacagcggttaaaaagttcttgaaagaagcgatccgtcgcatcctgcaagaaggtgaagaatccttacacgaacacttcaaagtatttgaggaagagtataaggcacttgactaccgagaaatagctggtgtatcatctgctaacaatatctcaaaatatcgtgatgattttggatacccaatcaaagggacaccaaaccacatcaaaggcgttctgttcttcaaccgccatacaaagggtattcaaggaatcaccccgattatggaaggtgaaaaggttatggttctgccgttgcgagataaaaacccgtggcaagctgattgcattgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgtttggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctatctgaaagcgatgttttcaataacatcaccaaaactcgaacccgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgacccagatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccaatggtgtgtatctgtcacacatacgacacacaagaaatgtacagcaagaaagtcatttccggtggtactggtctgatgtattccgcagacaccgcgatcatcctgggcaaacagcaggtgaaagaaggtacggaagttgtcggttatgacttcatcatgaacatcgagaaatctcgtttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacaggcgaacttgaactggaagaaaagaaatggcgtgaatcggaaaccaactctattgagttctggaaacctctgttcactcaccaaccattccttgatgctattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcccaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattactaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgttgcgatggacgatatcgacaacggaaacatcacctatgcggactataagaaccgtatggaacgcctcaaacagtcgaaggtcgggcgtttaatcgttaagcaatacccaacagcaggggcgaacgcgaaccacttcaaagcgctgattaaagagcttaaattgaagaagagtttcgtacctgatgtgattattgttgactacctggggatctgtgcttctacccgtgtacgcggggcggaaaacacatacatcctggttaaagcgattgccgaagaacttcgcggtttggctgttgaaacgaataccgtaatgtggactggtgcgcagactacccgcgccgcgtgggatgcttctgatatcagcatgggcgacgttgccgaatctgctggtcttccagctaccgctgactttatgttagctgtgattgagaccgacgagttagctgatcagggattgcagttgttcaagcagatcaaatcccgttacggcgataagaaccactttaaccacttcaaactcgaagtgcgcaagggtaatcaacgctggatggataccgacaacagcgatatcgggttccaatctgattataaaggtcgtcagatgccgaaaacgcttgaagaagcacaaggtgctatggtaaaacaagccgagactaaccgaagcagtaagttagccgaagtagcaaacagtacagacattcaattttaacggggcttcggccccctccaaaggtatagtgaaatgaaaaagattctcgttattgtgttcctgatcctcctgtctctgaaactggcagcaatcggggttatggcaaatgcttcatggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatcttatcaacaaagcataaaaattaagccccgaaaggggcttttttgtatctataggtattgcaatccttcacgaaaggtgataccttattctaaacaaacaaaggaggacatcatgaaacttgcaatcgcttttatcttactggttctaaacgcacttatgggatttccgttcccgtggttggtgcttctggctatcccgtttgcatggaacctgttcagaatcggtttggcgggttgtgttggtgtcctgatgcttatcatcggcgctatcggtggcaaagacgcttttatcggtgttctgaaagccatgaaagagggcgttaaagaaggtttagtgaaatgatgaatttagatttttgtaaggctgaaataaaagctgatgcagacgaagaagaaccgaagttcgatagtcctcacagttcgcgctggatcgtagctgttgacgatgaaggttatgttacggtattatctcgtccgttcattcacgatgcattttttgagtgtggacgcagtgcggaagatatcgggcttcctgattccgtagaactgccgccaggtgtgtacgaatggatctgtggttttgaacaaactactgactgggaaaccggatacgtggacgggtgggaattctaccctaatgaatcaacattactgtatagctgggacaatggcaaagttaacgaaagcggaaacgaagcaacacaacaagataatggatctggtggagtctgacaaggcgctaacctacgacgaaaaattattcattatcgaaaacttccatgaaggtgcatttacgaataactctgaactgggtgcattctttaccccgatcggacttgctcgcgatttcactattgatgcttgtaccagtggaagcgttgttgacctgtgcgcgggtatcggtggactatccttcgcgatgattcatatgatgatgtacgccaaaccgcgtgaaatcgtctgtgttgagttaaaccatacatactataagttgggtaagcgtatcgtaccggaagcgacctggattaacgcagacgcgttaacgacggagtttgatactctgtttgatatggcgatcagcaatcctcctttcggcaagataaagacatccaattttaagggtaagtatacgggcgcggaatttgaatataaagtgattgaacgtgcttcacagattgcccgtgcgggtacgttcattctcccgcagatgtccgcgaattttcgttactctggacggcgttatttccaacaggacgaatcaacgacaacatcgaaatgcaaaaagtttcttgatgaaactggccttgaaatgcaaccaggttgcggcattgataccggatattatctggaagaatggaaaggcgtgaaaccgatgtgtgaagttgtctgtatggaattccccgaaccggagccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaaaacgaaggaagaactggaagcatattccccattccatcgctctgtgagacacatcaagcgccgtttaaacgcggttccttatatgtctgggttcatgaaccttacaagtgcttatgactcgttacggagccgctggaacctgaccgagcaagatcacgaagaaatcatgatgaacctcccagaacttcgcgaaagactcaacgaagaaatggttgcaggtgattcaggcggaagtgtggataatattgcttcgggtgtgactacaggcgcgatcacgaacaaagggccgaaggttctgggttctacacgtccgcataaacgcaaacgtaaaatcatgaagagtgaagaatgaaaccattaccgccattgaattatcggatctgggttactgcgaacaattacacctggtttcctatccgtatcaagtacatgagcgacacagcgatcgtgtacacgaacgaaagaaaaacatcatcgggtgttgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagactattacccggatgattataccgcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgaccgcctctggtttacgcgtcaatggcaacacctggttaactctgtgaatgcggacgcataccctttaccgaaggatgaaccgcgtttggtgatccctatctttgatgaaaagggtaaaatcgagtcattccagggacgtgccttacgtgacaatgccaacgcaaaatacatgacaatcaaagcgtgtgaacactcaacgaaagtttatggtcaagataccatcgatccgttgaaacctgtctacctgcttgaagggccgctggatagcctgtttgtagataatgctggtgcgattacgggcggacaaatggcgctgtctgacgttccgtataaaaatatgcgtgtctgggttcttgacaatgaagcgagacaccctgatactactcaccgccttttaaaattaattgaggctggcgaaaaggttgtgttgtgggacaaatgcccgtggccgtcaaaagatatcaacgaaatgataaaaacggacggcgcaactaaacttgaaatcatgcagtatttgaaagataatactgtttctggactcacggcaaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattgcagaacggaattgacccgctgcaaaagatgctggacttgcaaaaccatgcacaacaaagcctgtctgataccctgaattgggttccacgtccgaacgaactgaaaacgtgcggtgagatcctggactggctgaaactgcaagatgatgcgatcgcagacgaaacccgcgaactttacaccgctctgggcggtatgtctcgcggtgcaaaagcggcttccggtgtctggaaaccgtggaaagcaaatcaccaggaactgcgtagccaggtattcgcagaaatgaaagaagaagacaagctggaaatcatgtttgaactgattgaccagtggcacttcttcatgtgtaagttcctcgcgctgggactggatgcggaaaccatctacaagctgtatgctctgaaacaggcggaaaacctgcgtcgttgggctaacaactactaatggaactcaccgcgctacatgccgtatttgctttgtcttatatcgtttgcgcggtgataacgtatctctttggatggtgcgttttccacgttaacggtgttgacagaaaagccgctttgatagtattatcattgctatgggttataggttttttctacgtcatctatgaggggcgaaaatgattgacaaatactatatcattgttacgaaagacaaagacggctttactattccacacgttgaaaacgggaaaacgccggaactgtttgcatcaccgcaacttgcaaaagataaattagattttatccgcaagtgctacgaaaccaaactgaactacacgccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagcgacgatcagaagtccgcgcatgatcgcgtgatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggaaagaaagcgcctgatctgtctacctgtcgcgtgttcgttgttgaagaagtctcaatggttgatatggatctgttccgaatcatccggcgcagtattccaagcaacgctgttattttgggactgggtgataaagatcagatccgtccggtaaacgccgatggacgcgttgaactctccccgttctttgatgaagaaatctttgatgtcatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcagatctttaccgagattgtgtataataacaacgaaaaaatccgagtcttagaaatcatcccgcgtcgggaagttatcaaggcggagaagtgcgacgagaagatcgaacttgaattctatctcctgaaaacggtatcgctcgaagaggaaaccgaagcacagattcaagttgttgttgatccggtgatgaaagaccgtctgggcaactatctggcctacgttgcgagcacttataagcgcatcaagcagcaaacaggctataaagccccgtggcattcgttctgggcgattaaaaacaagttccaggatgttaagcctcttccggtttgtacgtaccacaaatcgcaggggagcacgtatgaccatgcgtacatgtacacgcgcgatgcgtatgcgttcgcagattacgatctgtgtaagcagttaatctatgtgggagtaacccgcgcacgttacaccgttgattatgtataaggggctttgccccttttgaggttattatgaaattgattatccttgtaaaagacattccccgaattctggaagcactcgataaaattcgagaaaaagacccacatgcgttcaatatgttcgggatgtatagcgcagcagatccgcaagaagttattcaccgtttgcgcttcattgaaaaatctaacgatgttctgtattctccgaacgggccaagttattcatggtctcctattgcaaaagaaattgaactgacttatgatgaatatggcgttatcgtgctgatccttcgaatggcacgaaacattcgtgaagataaagacatatggacactaatatcatgaaaaaagatatatctatccagatccctcgcctccacgcggaagcaattgctgacctgatttcgaagatacccagaatcgagatccctttacacattgattatgatattctgtatgaatttttcgatgctgtagatcatgctacccgtctggaaaaggcgatctacaattccggtctgcgtcagttcggtatgatgactttgcaaagcaaagagtttgaaaccatcgacatcaacccagaagttgcgctggcgctggcttgttttatggaatatatcaagcagaggacggcatgagtcatttacccgtagattacgtatgggattatgaaacggttggcccttccccgaacgggaaggtgatcgaactctcatacgttccgtttgttgatgatccacacaacccgccaacgttcgcggaactggttgcacggggacgaaagtacaaatttgatttgcgtaaccagcctgatcgtattgctgatcagggaacaattgcctggtggaaacagcaaagcgaagaagcccgtcaaatcctgaaaccgtcgccggaagatctggaactctatgcaggacatcgacaattctttgaagacctaaaagcggacggtgtgagccgttggcaatcactcgattatgttcgtggccctgaattcgatcgcggtatcctggttgatatcgtgcgtaagatggttggcaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcgaaagcgcagatgtttgacattctcatgaaccccgcgttcgttaaagtcgaatacgatgaatatgttgttcagcctggagatagcatgtattcaatcgctgaaaaattatacggttgtggtgagcgctggcagtctatcgctaagttgaaccgcaaaaccgttagcaatgcaagctatatccttccagggatggttctgaaattgcctcagttagtcgaattatgataaaaagcccttgcattcgtgcaggggctttgttattttgtagggactgaaacaaaagaggataaaacatgtttggtgatttgaaagaaggtttgaacattttaatcggattcgcgatcattggtgtgattgcttgtgtgtccggcgcggtgtggttgtcttatcaggcgatcgtgtggttgggtgaatggcttcacattctggcacagtaaggggatattatgcgtttatgtttagttggtgtaggtttcggtcgtgcgttaactcaagggttaatcgactcaatccgctggattcagccaaatgttgaaatgtattcattacctaaccggatcgaatactctgatccaacaccgtacaaaatgaaaccttatcaagcgccacgcgttaaccgtgcgttacaccgtcaatctgtaaacaggggtaagtgatgaaagagcttacgatcgtcgcagcagttctgattttcatcatagtttcaatgattatcgtcagactgtaccagcacggggaagcgtttgaatggttcctggatcacgacaaagcgtttcgaaagcatttcgcgggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcaatgcaaggggcttttttgtatattgcgcacataccaaacggaggcaactatgacacgtattaacacaatcgatccttctcttcttctgaacgaacacctgattgcagaactgcgcgaactccctcgcattcccaatgccgttttatccggtaaggcaaaaatcaacctgtcaaaaatccctgctgtgtatacgctgggaaccggacacgtaaccttcttttacaataagctgggataccttcgcgatcgtcatgctgcattacgtgctgaatacctcgcgcgtaatggtaaagaatacatggacggtacatacgaagatttcgatcttagtccgctgtcaaactccctgtttcatcgtcatttgtgcgcagattggcaaccaacgccggaatcagtgaaaatcaatgttgagcgcattcgtgaacgtttcgaactgcgcaaacgtgcttatcggttcggtactgagatcatcaacgacgaagccgcatgggatacgtattacgaaaaattaaaagaaaaatacgattttctttgatttgggtattgacctgaatttcgatatgcagtatattacacacatcgaaacgaaacagacaaaaggaacgcatcatgaaaaacttagaagccaaagtagttaaagtcctggttaagaacggtttcaacgaaaacgacgcagtagttatggttgaaaagaatctgaatgatgcgttgaaagttagaccagaagcaaaacctgctaaactcgcagaggtgatcgtatgcatcatgtaaaagtaagcatcaaggatatcacggtgggcgacaccgtgatccatgaagggaaaatgaaaactgttgggaaaaatgacatcaaacgcgatccgctgttcggtgttctcctgttcggtgatagtttcaacctgggaagaacttttatcgagcgggttgttttcccgaaatggtatcaagggaaacgggtttaacaaatagcactttttgctaaagacttcatgggatagctttgatatagttatcccatagaaacgaaacacacttaggagattttaccatgtatacttttgacgaactgaaagccgcagcacagcctttactggacgcgatgcataaaggccgtaacactggcatgtggttcagcgattacaccgaaactgtgttcgttctggaaaaaggccgtaagtatcaccgtatcgtgcaggatacccgcaacaaagaaactggtgaaatgttcaatcagcgttcagttgctggcttcatcgacaatgacggcaatatcctgaaagccgcaggatggaaagcacctgctaagggtattcgcggtaatatcttcaacaacccagagaacgcgatcgaccgtagcgggtacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagattttctgtgtattacttccccgcaacgcttccttttcaatatggatcgtgctagtgttatgcaagtccagttagtattcctggatcattactccaaagtgccggaagtgcatgaatggaacctgaaaacatataatgaggttgtgaataaatgagcagacgcccaaagaacagcaaaaccgaaatgcatatgacgtttgatgtaaacggaaaaagcatcgagggaaaaccatgcacgaactcaaagtttatgcatattgccggattgcctggtatgagtgttaaaacttcgtatgattgccattacaacgaagaaacaacctctgtttatttgggcgaagaactcatggctgaacgcgtcatgcaatgtgtgcattttcccggcgaacgtccagaagtgaactgttttattgttggttatcataaaggtattgtaaatgagcaagtataaaattggtgatatgtacgccccgaaatctatgttaatggctgtgtgtcaaatggcatccgaagccgacccgattcgtcgtatgtatgatgcgttgcgtaagaacccgatggacttcaattcaccacgccggatcagtatggtgtatgaagaaacagggattctttatcttgaaggtattcccgttcctatcaagttcaacgatatgaaagggcttttcaatccggtatgggttgcaccagaaccagaaactgaaattacgatccacgtcaataaaggtgaggaagtaacgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgcgcactggatgtgatttacctgaaattgagcacaacccacggaacaacagaaatcgcacaggtgatcaacaaactgcttgataagaaattagataagtggtacgatacttgtagttaatcaattacgaggatcggatcatgttggtttatcgcgttgaattgaaagcgtctatcttttcgtcatatgatggttggtgcaaacagttagggccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaagcaatgtgttttcagcaaagccgcaaccccgatccgttttattccattgtcagagatttattaatgccaacatatacctataaatgcaccaagtgcgaaaaagaatttccgaaaatgtccagcatcgcaagccgcgacgaaccgaaagattgtgattgcgggggcgaggcgaaacgaacggttgataagccgcagatggtgaaagacggattcccgtacaacaagtaaaaccccgaaaggggttttctttttcatagaaccctatataatgcctgagaactaataacgaggtgaatatgagtttagatttcttaatggacgataacgagccgcagaaagcaccagaagccccagcaaagggcgctaaggtggatgaatcattctgcttgagcgatcgcgatcacattcgcaaacgtccgaatatgtacgtgggttcagtgaacaaagaagcccatgaacgttttatcatggggcaattccgcaaagtggaatacgtggaagggttggtgaaaatcatcaacgaaatcctggataactccatcgacgaagcgatccgaactgatttcaaatatgcgaacaaaatcgaagtgaagattgatcacaatctggtaacgatttcggacaacgggcgcggtattccacaagatgacgtgagaacgccggaagggaagattgttcctaaacctgttgcagcctggacaatggctaaatccggttctaacttcgatgacgaaaaccgcgtaacaatggggatgaacggtgtaggttctttcctgacaaactgttacagcgcgatctttatcggcgaaacatccaacggtaaacacaaagtcacgatcaactgtacggacggggcgcagaacatggattaccgcaccagcccgacgaaggagcaagggacaaccgttaagtttacccctgacttctctatcttcggtgtggacggtatcgacgaagagacaaaggaagtcatcaaagatcgccttatggcgcttgcagtggctttccctgccgttaaattcacatataacggcgatatcctcccgaacaaattcgcgatgtatggcgcgatgtacggcgataaaacgattacccagacaaacaacaaaatcagtttcatcttggcgagcacagaagacggtttcaaacagaaatccttcgttaacggtctggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggtgattccgctgtggggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggcgatattctcaccctactgattgcgttctttagccgctggcctgagttgttcgagaagaaaaagatccgttatatccgcacaccgattatcattgcgaaagtcggtaaagatgaaaaatggttctactcccttgaagatttcgcaccgttccgcgataaggcgaaagaggtacgatatatcaaagggctgggttctttacgtaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtggaggggcttacatttgctctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgacgggttctttggttcccgtctggttaagaaacctggcgcaccgcgttacattaaatgtaagctgtctccgctgttcaaggctatctatatggacgaggatttaacaatcccacatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacactggatctgaaatacccgcatttcaaaggtgacattgaaaacggtactatttacggcaagtatgaactccagggtaaaaccaaactggtgatcacagagattccggtcaagtacgatcgcgtgaaatatatctctatcctggataagctggaagagaaagggtatatcgtaagctacaaggatctatcaaaagaagatttccgctacgaaatcacccttaaacgtgagtacgcaaacgggcttacccgtgagaagatcctgaaagatttcggattgattgagaactcaaacccgaacatcaacgttatctttaacgggaaactgcattcatacgagcgtcctgaaacgttgctgaaagacttcgttgatatccgtattggtgtttaccaacagcgtattgataaacgcatccaggagactaaagaagcgttagataaggcgctggcgaaggttgacttcattgaccagatgatcgcacaacctgacgcgttgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacaaccccgaaaactgaatatctcaatgatttgaaagaactttcgaagaaattgaaataatttacaaaaagcctcttgcatcgcgggaggcttttttgctatagtgtcctcactgattggggaggatataaaatgttcaaaactcgtagcgatatggaaataaccatctgggccaaaagcatcatggcgaagcatggcttatctcattggtctttcaaaattaacggacgtttcaagcgtactctgggacaatgcaattacagtcgcaagtcaattgaattaagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgcaaaagccgtatccgtgagaaatcagtaattcaggaaagcgaaaaagacatatacgcgtttttcctgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgagtatgggcttgatcaaaagcctatgaaatattcatgtgataacatcatcttcaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatctacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagtaaatccccgttctgttacaccgaaacattcactatcgaatccatccaggacggcgttaaacgcgcatacacggcttacatggataatggtgaacctttcgttgaccaaatctacgaaatcgaaacagacgaacctaacggcgttcaaatcaccgttcctgtgaaagttgaagatatcgcagaatgggaaagagaagcggcgcgtgtttatgaaccgtttacaggtatccgtccgcgctttattggtgttcagattgatgttaactggcaaccaaaagaagcagacgatcgcgggatcatccgttatcagtctaaaaactattcaggcgtatacgcgcgtatgggtaacatttgctatccaatcgacctggatatgtttgaaaactcgctgttctactgctaccgtaacagcaattacgcatatattctggatttccctctgggatcgctggacttcatgccgtcgcgtgaagagttgagccttgataaagtcacgaagaaagtgattacggatcgactggataaaatcaacaaacgctttgatgaagagttgatggaacagtataaaaagcagaagacaacccgcgataaactcgtatggttcaataatctgcctagcttgttacagacattcgtaacccgtgataaccgtttccgtgtgggtaaagaatcgctggctgaaattctgacgcgcatcaaaaaccctgatacagcaaccggaaaatatgtgtggggcttctgggctaacccatatgacgggaaagattgcgtattcgaacgtgtgggttctggtcgccgttatgagaagtataaagcggaaaccaccaaacgccaggacgttatgcgcatgatccaaccgtggcgacagaagaaactgttcatcgttgaaaatgataacgaagcgcgttcactccgcccgtatctgatcggttactgcatgatgaacggttcggatcgtatcagtttcgtaactgccgatcgtaaaagtgactctgtgcgtcagttgattgaaactggctatttcgatgaatctgagatcgttacactgaaaaccagtgaattgaccaaagaattcgaaacgtacaccgaagatcgcaagcgctggaaagcaacgcgtgaatcatcttctggtgattctgaaccacgtccgaaaacgcctacggcatatcattacttcctggatgaccagggtaacttacagaaaaatgatctgttcctgactaaagcacagttcgtgaaactggatgaaatgtacgctatgcgcctctatgggcttgatgaatatagccgactggacggagaagcaccgaactatacactgggtagtattgccagcagtatgatgaccctgttgaaagttactgggctgaaaggcgttatggttctgcgaaactctctgtggagtcgcattccagatagcaacatgaaatgtcttgatgactatctggtacagcgttttgccgacgcggtgaaaaagatgaagcctaactggtatccagcctggatctcgtctaaacacggtagcgaggttcgaacccttcgcgattatctggaggtgactcttgatcgcatggtgaaaaaccgctataattcagaattgtatttgttgcttgattatcttgatggtaagtttacctacgatactatcgagaacaaaaacaaatccaaaaatgtggtgcgtaacccgttacttcgtgaaatgtctgtgaagcattacaaaatgctgaaagatatgaaagaacgtgttgataccgcctttgatttgtttgaagaacgcaaccctgcattggtgtatgtgttgcgcaattcgtcttactctttaggccgtactatgattacggacgataagatcaagacgaacctgattaaccttatacggtggaaataatgagaaacgttaagatccttgacgatgtacagaagaaagcagtctatgagggctttcttaccagcgcgaacaaaaccgcactggctaaacaatttggtgtaagcgtccgaaccatcgggcgcgttattaccgagcaacacgctaagtataatacggaagcgacgaaaccacttccgcaaacagatgtcaaatctaaaatgattggttctgaatcgttcattactctggtactggacggcaagatcatcacagcggattcgtcacaccctaacttcgaaaaagcacacgctttaatggttaagggagacatcgagggagttgctaccctgttggacacaacgcaagcgttgaagatttacagcaaaggcaacattaaaatcatcgggcataaagtcctgtacaaagatatcgtgtttgacagcggcatcacgcaacgtatcgttcgtgaaatgtacaacgaccgcccttacgagcacctggttaacttcttcgagaagttgatggaaaacccttcacgcgatgctgtgtatcagctttatgggttcatggtgcataatgatatcgaactggcagatgacggagatttctacgcgtggaaacgtgttcgtgaagacttccgcgatctggcttccggtaagttcgataactcccctggtgttgtggtggaaatgccacgtaaccaggtagacgagaataaaaaccgaacctgttcatgcggtttgcatgttgccgcaaaatcgtacctgcctcattatggcggtggacgtgggcgagtcattcaggttaaggtcaatcctcgcgatgttgtagcaatcccgacagattacgacaacgctaagatgcgtgtatgccgttatcaggtgatgcgtgatgtaaccgtgggattcagtcactactaaccccaaaacagcgcctggagcgattcaggcgcggaggattcgattatgaaattcctacagagtacccccgactactggcagaacttgagcggggcagaaacagccattaaaaccgctaaagaaatctggaacggaggcaacgttaccgctggacgtacagaagacggtgaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgtggtgacttcaccaagttcgaaggggttgacctgaaagaacacggcttctacctggtagttgatgataaaacgggtaaagtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcaaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattatctaaaatggggctgaaaagccccaataaggaaaataatatatgtttgtaatttcttcgtactatgattcacgtcaacgagtatcgttgtcttctatttccaaagcaccaaaagatatagatgacttcggattgcttaactttgtcaaaaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacggacattatgtgaacggatgcaacaataccccagaacaggatcacgctgtcaatatcgttaacctcatgttagggccgcgtacagatgacaacctgaaatgggcgagcgaatccaacgttcctcatgagtatgtcgggatgtattatcagtgcaacgttgacgataaagcgccactgataccggaaaaacagatcgatttagtagttcgaacaggtttcttcttatgagttcacaaattctgttcagcaaagaagatccattaggcacagattcatcggtgcagcgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaagcccttgacttcggttgagggcttttgttatattggccttgtcgaaacgaaaccactaaggagattcaccatgactaacctgactaaagttaccgcgacatatttcatttcttctggcgctaaaaacgctatgtacactctgcgtgtagagcgtcgtggaggtgaattcacttctgataactatatctgcaacctgtctactgacccagataaagcggaagcgaaagcgcgtgaatacttcgatcgcatggtggatcgtctgaaccaaaccgatactttccagatggtgttccagggcttcgcagatttcgatctgtttgaacgtcgcggtaaactgtccgtacaggataccgaaaacctggaactgctggaacagggcatcatgccaatcggtaagcgtaaaggtgaagtgattgctgatatgccgatgtatacgattctgtggtgggctgatcagtgcaaagaaaacggcaacgatagcccagtatttcaggctatttgctcttactgcatgggcgtagcgctggagaaggattacatcgctaaacgtgaagagatccgcgcagaatgggaagcagagcgccaggcgaagatcgcagcagcacagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacaaacaatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataacaacgacgaacttgacccgatcttagtcatagataatcacccactgggtgttcgtccatacatctatcacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaagcccgatgacgaaagtaaaagatttcatcaatcgggctttgagtagtttgaaactgaaattatcatcgaatcctgcctaaaattcttgcggcctgattgcacacgatcatcaacttcgtatcggcgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatacggattcaaacttttttgccttttcaatctccatcgtcggcacgtctataacgcttgaagatgttttccagactgaaaataagtcatcccacttgtaccatgttacgaacataatgaaaatagtgacgataagaaccaatttaatgaataactgtttccatgttttgaccgccatgatgaacgatattacccgttcaagcaccgccaatttatcttgtaatagtgccatgtttaaacctcaagttcggggatgccgacccccgaatatatttaggaatttacttaacgttgcgtaaccaaaccagaacggttctgacctgtacgggcgttcagatagtcataccaactggtcgcctgagaagaaacaacctgatattgacgatatccatcatgtatacgtccgttgttgtcaaaatcgaatacaccgccgtcatccatagtaagacgtaggttgacagcaggaccgttttgaatagtaattacactgatatcaggtgttgattgtgctgcaactacagtaccgaatgcgttgccgttaaaactaccaccaaccgcatcatgaccggaaggtttcgaatatggtgaataccaaccaaccccccactgaccacgataacgggcgttgttatagtaacgctcatacaccgtaaagttgatgttatataccgattgtcccgccattcgagacatataaaacggtgttccgattcgaaccgcattacccgcagcagacatccatcgttgccctgtttctgtgaccgcagacgaaccgatccagccagggactcctacaatagccataaaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggtaataccttctcaacatcctgagctatcagaccggattcgcgatggtatacgatatcatcagcatcttttgattgcttatcgtagatataacctttaagctgttcaatcttgcttaatgaatctttcaattcaaccaaattagatttcagtcgaatatcggaacgaatatacacatcgttggcgtttacgttaccttcaacatacagaccacggttcatatacagatccgaagtacgcaactgtaaggtcgtattcagtcggtagttgtgtaccgatacgttatcatcagcaccaccaaacccgaagtatgcgccgttgttacctgccaaagtaatcagcaaataacatgattggttagtcgctgtgttattcagaagtaatgctggcccgttaacaccctgaacctgtaactgtttatagttagcagttgcaccagtagtccatcgcataatacgctggctatttgcataggcgttgagaataccgtcaccttcctgtttgaaacctgtatcgttatcacccagagaaataccagtcgtacccaatccgtttggcgtaccacaaccaataccgtttgtttcgaccgttccgttgaagtttaccgcgttgccaaagttaacagaaccgttaatgttcgcgccgtttcctatagaaacaataccagtagtcaagctgatagtaatcgggcgtaaactgttccatgttccataaggatcgccggagttggtgatcaaggtatagtagttaccaccatcatttcggtgtattaccccgtagtttccttgtaccgcgcggaactgtccaccagaaccagacgtagcgctttgaacttcgttacggaatcgagcataacccgcagtagaaatctgcaattcttcctgtccgtctgtagaacctgttgccagtctccacacaccaccctgaacagtttcatgccagattgtgtccgcgttaccgcctcggaactgacgcaaatagtttttcccgccctgtccaacagtaggtaagaaatattgcgctggtgtgccctgtggaacgtcgttataatacgatggtacgtttacgttaagccccaatttggtgttgatagaagtcgaaccagtaccacggaaataatggttatatcgtccgttgccgtctttatagcctaagtgggtaacaccatcaccaaccccgtttccatcaccgtttgtttcaacacgaagaatcgctgagtttattccttgcgaatcataatctacgcctacagaagcacggttattgaacacacccagaccattaaatgtagcctgaccaggaacggttagatggttagcgagaactaaagttccatcagatgcaaaacgagttgcatatgcaccaccgccagtacgaacatataagttctttcctgtatcagcatagatcaaaccaagctcattaccgccagcatcctggaagtataggtttcggttcgaatcgcctttaatagccatttgtgtaccaaaaatagtaccactaacaacagtctgcattcctatcgttaaaccggaacccgtcatagatacttgcccgttgccgtttaggtaaatctctgctgttcgcgcaccgcttgcgcctgtggttgtatttggggctgcaaatgcttgcaatgttagtgatccgttaccctgtgctgtctgatctgctaatacgttagccaattgagcaccagaaaccggatctgctgtagttgcggcacgagcagtgatagtcattacacgaagtgtgtttgatggataaccgaccgttgttgggttgttgtctggacgtacaaacaacacatagggatcgccatttgccgctcgtttcatcaggaggcgatacggaacagttaattgactatccggtcctgtaaggttcagagatccggtcatatcgtcgccagctttcttcacctgtgcatcgttcgttacgttgcctaatccgatttctgcctttgttggcttatcgttttcggtgtagattttaaagcctttatatgtgattgtgtttccagaagggagcaaaggcaagttcgcctgactccagatagtattaccgccaacggtagtacccgcttttaaatctgccattattagatcctcaaatgcttttatgatatttataaaaagaaaaagccccgaagggcttttaattagcgggatttaagttccctgacttcctcacggagttcttttaccgcgttaaccagcaaggcgataacagcagaagaagaaacagttaagatctcgttctgttcaccatcaacacctttcttaacggcttccggtaatacttcttgcagttgttgtgcgactaaaccagcctcacgggtagtttcttcacccccgatatgatttgctttgtcgtacaccataccatcaagcaaatcaactttatccaatgcattttcaatcttactgaaattgcttttcagtctttcatcagaacgaatatacacatcgctaaagctaccgttaccgttcattaccaactgaatgccggatgaagggttgcgttcaaaataaaccagatatgatgcactatcagagatttcaatacggtttccacgagaagcatcaccagcatggaacatatacatatcgcgagggtttgcaccactgcgaataaattcaacgcgtccgttgccgctaccgtttaatgttaaatttccattgtcaatataactactagattgactaatacgaccattaacggataacgtatgtcccattgtaacagcacccgtggtgttgctgtaataaatcggacgcaaattgttatatccaccataaacatcaccgctatttgtcagtaggaaatacgtgttgtttccgtcactacgaataaatgatccggtgttgccatatgcgatacgaaatccgtttgccgaggtggtaataatatcaccagatgatacaaattcacctgaattgtcaaaataccactgccgatctaccgaactcgtgcggtaatgaacggtaaatcggttagtgtttaccaacgtacccatagaccaagcaccaccagcttgtgtgtaatactgtttaacaataggccagtattcggaagttgctgttgtgttaatggtttggaaaattggagcttttgcggtgttttgtgaagcccatgaacctctcccttcggcagatgtatcaaaatacccgcctgtctggttgattgttcctgttacagtaccacctgtatttttcaagaataaagcatcaatccatcctgcaaacccgcttttgttgatatacacgttcccgtcattagccagaacaccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcaatgtacggcgatagttgacaacctgcccgtaatacgtagtgttaccatatggaccgtcggtgatgttaccgcctaccgacagaacatcgttcttttcagttacaacagcagcaccgaaacttgttccagacataccgcgaggaatgcccgtcatatatcgttcatcatggttagcccagtttgtcggggttactgtattcgcagttaccgcaccgctaaccgccattgatgcggcgttcgtcacaccaagattcgtagtaccgattacgcgaaaagatccttgctcaactgttacctgttgggtttgcgaatccagcgttaaacttgtattaggggaaccgtctttattcgcccgcagatatactttatttccaccgtcagtactagcagaaataatcaacgaacccatgcctcgattcaaaccatctttcgcatacatgtttaaaacccatgcttcagatgacggggttgccgtaatatcgggacgatagaaaatcatttccgcagggtttgcgctacgttggatggtaagaacactattcgattgaatcaagttagcagttaatgaagcacccacaaccaaattctgattgaatgtagtattcttcgcaacagtaccgccgttaatcgtcgatagtgcgtctatatcctccgctgttggacgatcattttctgtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttatctcacgattgacaaattaacgtctttagcggatatcgtaccgatgtttgtgttgtttggataacgatataaaccgaaatcaaacgtaaccgcaccagcaggaataaccccttcgtttttgtagaatgaatatacgttcgggatcgtaccaacatcacgcatgttgatccctgaaatatacgtattattcgcgtcccagaactgcattacaatatatgcgcctttattgttagcaatcgcatttgcatcgcgtttcatttggcattgcatacggatcgtatcaccagcttttaatccgtaactgcttagtgatgctttcgttaccgccgcttgctgggtagcagtccattctttgaactggtactccgctgtatttgtcgaagtgtattcaaccggatcagaaacaatataatcaagttcagcaaagttatgcgaactgattttcttgtcactaataaccccagtaggcgaaacaggcagagaaagcaatttatcaatcgggttttgggttccagcatcatcaacttcggaaagcgtttgcatcctgataccatttacaccaattgccgccccgttgcgatcggtttcgattcgtggaactttactgatctggacattgcgacactgagcaagccccactttcacggtagacgggtagtgatataccatacatcccatcttcacgtttagcgcgtccgtagggatagtgaaatatcctgacagagaatgccattcatcaggagctaacccagttgttcgcagtaccgcagaggatatccattgaccagaggcgttctgtgtccacatatagagataacattcgccgccagcattgcgaagttcttgcgagcaataaacatcaccagtgaacttaaagatgtcccccaagaaaacagtagaaccaatatcccacatcccatataaatggaagccgtaagcactgccactgttctgatatacctgaacatcatcaaccattctttcaggaataccagttaccccgatatcactgaattcatcgaatacaacctcaacaaaactcgtcgtgttgtctttgagtccagtaccagaaccacctacgaagttttccatacagatctttttcatcgtggatgaatagattgctgaataggatgaacggtgcgggttgtttgttgatgatgacggcgtgttaaagaatcgtgtttcaggccatgcaactgatccgattgtgcgcatataactcaaaaacgcatcggtagattttatagcatcgaacgtatagaaacatacaattctgtttgctggaagtgtagataggtaatcactaatcgcagtcccattcgtagtaggatcaccatacatatcaaaagttttgaaatccagcaaagccaaactcgtaccgtcaattacagcaaggttaatccctcgaccgcgctgtacgtttcggttaataatatcagccccattgatagatacctcaaccgagttgaccgcagaatcgttattcgttccacggacaacaaggcgatatttcacggcgtttgcttctgaaaacacactcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgccaccgccccgatttctgccggagtcggtttacgacctgcatgatagatcaggtttccgttgatcatcgctttgttgtaatcggtgatattgatgttgaactcagtcaataccttatcgtcaatgccagttaagcgcattttctggacgttcccagagaaatcacccgcctgaacatgtgccgtaccgctcacactggtaaagcgtccacccgtaccgtttacgctaactgacagcgcaccagtcatagtatcacccgctacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtacttgcaacaaacaaatcacccgccgtgttgatgttagccagagctttaccattcagacgaatgttcgtaccggaatacgccattgtgccgttaccgacatcacctactgtcagaacgtcaaccagatccgttgtgcccgtcgccaggcgatacgtgcttccctgaacagtttcatgccagatcgtatccgccacgccaccacggaatgtacgaagcaagtttttggttcccgcagcctcaccactcagaacagtatttgcataaacagtgtttgctttcgcagactggttaatgttattgttcgtggttacggtgttgttaaccgttaccgcagcgttagccgtcagtgttccgttagtggttacgttaccaacgaagttgcttgtaccgttaaacgtgttatttccagttaccgtctggtttgcatcacgacgcatccagcttgcagcaaccacaccgcccagactcaaactattctgcgccgttgccattttcggtaagaagttttgcagagcaaagttcagaccgcgaggcgatacagcatagaaatcttcaagataatcgtcaacggcctgagtagaaccaaccagattatcaccgatgaaagtgtttgctttggtagtgataaacaccgcaccgcgtcgatttgtcgttgcaccccacgccggatcagtaccgttcaagaactgcatggtagccggagtaattgccaggttagtagcagtacccgcacccgcttccgcgttagtcgcacaacgaataataccttcggcggtatccgtcgctttcttcgcttgcagtttcttaggcgtaatgaacacggtatccagaagacccgcatcagtttcaccctgagtcgcaacacgtaaagtaccgcgctgtgtttcagtagcagacgcaatccccaggttaatcgttgtccagatagtgccggactgagttaaaccgtcatcggtagcaaccgcaacatgacttgtaacgtcgaagaactctttcagcttaaccggaacaaccgccttattcgttaccgtacctgctgcaacttccgcagtggtagcgagggcaataataccatcaagtgattcagtcgctttacgatcgttcagcttcttaggcgttacagcacggagatcgtcagttcccgtgtttgtttctgtctgggttgcgatctcaatcaatccgatacgcgtttcagtagacgttttacgatgcagcatttcaggagttactacgatcggcattgaagcagatcccgcagcagcaccagttaccacttcgttttcagtcgccagaacaaccagaccttttgacttttcggtcgccgtcttctcgttcaatgatttcggggtgatcagatcaacaccgttattgaagttgtagacgttagtaccagcatccccacgtaaagccccctccgctgtcgtagcgcccgttgtaacgagttttccgatacctgctaaggtttcggtcgcgcggcgtgtatcgagctttttaggcgtgattgcggtagtgtcatcagtaccagcgtttgtttctgcctgggtagcgatttccagcaccccacgacgatcttcggttgctgatcgttcgttcagctttttaggcgtcacgatcacgtcatcaaggaaggttgctgtcgtgttctggttaacttccgcagttgttgccaggcgagcgataccacgacgcgtttcagtagaggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgtatctttcagatacgacaattccatgtatggaagatagtcagtatcggcattgaaagtcagagtgtcaacactgaaccaatcattaggcggataatccttacgctgtgggaactgcatcatgtttttgttggtgcggatcttttcaccggaaccatctttaactttgatcgtgcagttctgcgttttccccatcatgtacatactgatatacacacgatcaccttcggcaacatcttgcggaagagtcagcgtaacgttacgcacagttggaggactaccagcaacaggagtaatgaacacgtaatcgttcggcaacatgttcaggtcatcactgatacgacgcagacgaacgcgctgatcaccgtcataaacaacccaacggttattagcctgatcgaacatgaaaataccataaccggaacgctgtgaagtcacagagggtacgttattgataccgtcataactgatcgtgtgtccgctaccaggataaacttgcagagtcgcaacgttcaccgaagcaaggcgatccagatcgtaagttgtgattgagtcaccatcatttgcgtaacgaggcaactgcaacgtaattttacccgttccactgttacggaatgttaccatacccgcttgcatttggaaagcggttaaaccagtcgcattaacaaactgcgaatcacggttatcacgcatttcagcaacacgccataagttgccgttaaaaataaacgcaacggttatatatgggtgagtcagtcgataagagcttgactgaatatcacgtaaacggatctgacgggtgtttgaacgtactaacaggttgttaacccctgcaagaccgccaccgtctttaatggtgataatatcaccctcaacaggggcatctggcagaatataggtcagttcagagaaacgaccatcagccattaagtacgtaccggattcaagagggagaccgtcagtgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccctcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcaggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagtccagaggacaccgcaaccgctcgcaacatttgacgaagccagggtaacgggttgtaactgaataatgccaccacgttagtataacttgaatagaagttcaatccgtgcgagttatacgggatttcctgcccctcgctaaacttcgatctgtatgtgttggtgcaatagatgaactgttcgccccctaaaagcgcctccacgcgttttttaatctgagtgtatactgtcgtcccagattgagagagatcgcccgtataccgcgaataatccccctctgcgagcacatgtatatgtatgcgcccagtgtttttgtattgcttaaagtcaaccagcttttgaagcggtgaatctttgaactccacatcatgaaacgtttgcaggatcttccctgtaatcgtgtctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtacagggaaaaatccttatacaaatcaaagtcatcaatgtttttgagtgctgcatgagtgataaagatcacatcgtaatcattgactacttcacgcagcgcatcgttattggttcttttggttcggtgatccgtgtccacaatcaccgcccgttttccttttacctggttgatgtaatagtcataagactgttttgataacatcatggaaatcgaagcgatgattgctttttcgcccgtttgattgatatggttcagaatcgcctttgttttaccgcttgaaggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagtatcattgcaacgatttcctgacgaatgaagttgcggctaaccttttcaggaaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcaattgcagataaccgccgataagtttgttatcgacaaaaatacgcgggtattgaaacgctaaactgcgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcggggattccgtatatttcgactttcattcttcttcccgtatggtttgagatcctgcaaaatacgctttttctctttgcctaacagtttttcgatattttcaacagcggttaattgagtgtgcagatcgaacaggtttgcaatctggtcttcctgcattttcagttcagattccatgttgatttgatagatgctaccaccactgaaaacatgttgcaaggcgaaacgaagcattgcatcagatttacgtactggcatcggtgcgatgctcaacgtttccaggttagccccaaatgatggatcgatgcggagatcacgcaaaggattttcctgtacagggcgatacgtgaatttagggatatccatcaggcacagatccgaaccagtgacaccagcggaaacctcttccggcgttgcgatacgcataccattttcagtctcgaccccgttaccgagattaacctcttcaggttcttctggggtgaattcaccctcttccggcgttacttccttgaaccatttccatagtgatgcagggagttcatattcgtaaccaccgtccatgataaacgcgcggtcttcgaactcaccgatcgaggtgcgatcaatcgtcacgtaacctttttcacgaatgatgtttgcgatacctgttttccaggttttctctgcaaagatttcaggggatacggttaaaccgtaagtttttccagcgaataattccatgattacctcaaataaaaaggggatgccgtaagcacccccgaattatattacttatttgccagcagtgcaagttttgcggcggcttcgcgaactgcgcgagctttctgcgctacaacttcgatcgctttctggtgttctgccagtgcgtcttctactgcctgtgcagcagcgatgaccagttgatcgtgttgctgtttggaaatatcaaccgcctgaactgctggagtgtttgccggattaccagtacccagttcacggaagaatttacgctcacggtgcatcacaaacgggaggctacgatcttgcgtgattgtcgcgtcaccgtcgccgtcaacattcgaaaacaccagaacaccgttgttgtttttgatgtgttgcacaatgcgtttgttcgcggtgtgagagcgcaggaaacctggttcatctaccagaacatacggacggtcggcaacaaaacaaccaggcatcgcttctacgagcgctggctgtggtgcagcaggtttagcaacagacggttcggttactgccggagcgaggttaacaccaccatccagttcagaatccagatccggtttcgctggtgcaggtgcaacagacggtttgcctactggttttggttttttagcgcgttttggcgctggggctttagccggagcaacttctgtgaagtatttcgcttcccatgcacgaagggtgttcatagcaacacctgccggagcattgaaggtgtagcgatcaccgttacggcttgcgatgtttacaacaccgttcagtaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccacttcctttggtgatgtttttcagcgggatcgaccacttccagcaatagtcacgggcttctttacgggttttgaaattcaggatcatgatattatctctcaattgggttaaatttatgctacgtggatatcttaacagaaccaccaaccaggtcaagcgatatttttaatttcgatggaattctttttgaactcaatcattcgctgattatccgaaccgcgaaacggtttcttagtcggttgatccttttcgtaccgtccatcaatcagaacatcaatgaatggtaacagcttagaacgttctgtatcgctctgtaaggcttcgagggtgtatcccgtccaaacccacacgtctttatcaggaaacgtcgcacggacgcgctcaagcagttttaagagcgttggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcatccagtcacaaacaacactacacggattcctttaccgttaaccacatccatgttatagatgcggtcaaagttcatcagcctttcgcctctgggaacaaacgggctttgatcgcttcgtcgataatttgcgggaattcattattcacgcgcttaacgatttcctgacgaaccgttacttcgaggtttttggttacacgagccataaacgcttcttcgtccgctttgaggtttttggttgcatcgttgattgcttccagcttgattgaatccagcaggtcgttacactgtttcttaacgtgttcgctgatcagttctttgatctgacggatgccgcctgaattgatatcgaaaacattgctgtatgcatagcgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacattcttgatgacagcggcttgcagatccattcgcgcttgtgttccttctgggaacaggttgttcagcgcttgggtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcattcgtcttccgtcaactcttttttgaatccgacataataagcatcagatccattccatgttgaggcgttaacgctacccaacagaacacgacaaggcatattgttatgcgcagactctacaacctgggagactgaatccagcggattgctaccagacacccagcggagcagatgacgatcatcaccgttaatcggatcaacgaattcaaatctgataccgttttcaatcagttcgtgcagcagaaagttaatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagcttgtattcgccttgcgtcgtgacaaccaccattgagatcagaacacaaccatcaaatcctttttcattgattttgtgaaagttcagcttatccgtagtgcttgccaggttcgcataacgatccccgcgaatgttaccaggagaactataccgcgaaacgttgattgacggaatacgaatatcttcaacgatatcacacgacgcaacagcttcaacgaaatcaagaattctggtcgctttgatgacgtgcgccttaaacgaaccgacttctaactcatattcatctttccagcctgaatagtagtcaaccgcagggctaatcgctttcatgagcgcttcgggaatgtcaatgtgccataactgttctgcgtactgtttgcgccagtctggatacgttttacgtgctggtttaaatgcactgttgccgtcttcgaacatcatttctttcctctctttttcgtaaatgtcatatacacttcttcgttcgtaagcgtctttaaggttgctgtttactatactatcatgcgtcagttcttcgcaatactttttatcccattcagaacacgcatgatcaaccatttcctgaaaaactcgctgtggaacattcccatctacgagaattctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacggaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcaacgacagagagatcaatctctttgttcatcccttccagttcttcgatcttcgtctgcaagccctgccagatgttacggtgttgcagcgccagaacataatgactgttggacacttcctgccccgccgccagcagttttttgatctccgactctttaccagaatgaagatctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgattggtgaaccattcaggggctttaacaactttcccctctctgatataaccgattttacacagttcgttggtcaagtcaagtctttttccacccgccatataaaattttaatctgcttactgggatcaccggacggataacgtcacgatagccgaaatgcgcactacgcaccactatagagagcatacgcaagcggttgatacaaccagtatacgaacgcccagtagcgcgggagaagtcctccagcgtaacaccaggggcaatagcacctatcaggtcaagataatccttttcaacccagaaccgcccgacagaacatttcgatacaccctcagccatttttgcgtttgggtgtttctcgtcttcgcgcttcttcttgtcctcaaggaacttattgaaccggatttcttcgagtcggttttcccgttctacgcgcctacgtacacgggagggaaacaaggtatcaaggattatcccggtcatcattcaccccgtagaactttcagttcaccagacaaacgctgtagattggcggttgcagtatcgtaacgtttttcggtctctttcagggtagtttcccgcgccttacgcaagaatttttccagatcgccaggtttcgtcaccagcttaccatctacgtaaattcgccccagcaggtgagaacaatccagcagttgttgcgcgtcggctttttcaacagcaggtttaagcgcgacaaactttttaaagaatccgcgatcctcgttatcaaacagataagaatcttcggaataccatgttgtgccattggcatcaacaatcccattgacacctttccgatcgcagtgcgttaccttgataggaaacaagacagatgaaagttgattaggcgacagaggactaccacgcaaagctaaattgcggtatacagtcccaaaactttcttcatcgcgaaattcaaaatagtcttttgtccagtacatcattttcaatacctcatagtttcggtatgtgcaatataacaaaagcccctcactttcgcaaggggctttttgattaattttgatgcttagttcggtgcatcatttctttgttcttaccttcgttgaatccacgaacagcaggagcacccagataaccgcatgtacggcgtgtgacgctcattttagccggatcttgattaccgcagtgtttgcagtggaaaccgtcttctgtaggcgtgaactcgtcatcagagccacatacaaaacacttatcgaccggaaggttagttccgaagtagtccagtttttccatcgcataatcccagactttttccagggcttgcaggttgtttttcatatcagggaattcaacgtaactgatatgaccagcagtagcgatgtaatgataatcggcttcatagtcgattttctcgaacggtgttaccttgcgatcaacgtccagatggaaactgtttgtgtaccagcctttatccgtgacacctttgacgcttccgaacttctcaaagtccagcttacagaagcgatggcatagcgattccgctggggttgaatacagactaaatccataccctgttttcttcttccatgcttcggttgcagcgcggagatattcaatgatcaatcggcctaatttctgggagccgatacgatcaaatgggtgttggcctgaaccaaacatcaacagcgtttcatgcagtccgatataacccagactgatagagctacgcccatttttgaacagttccagaatttcatcatccggtttcagtcggacaccaaaagcaccttctgtgtataggatcggcgcaacactggctttaacaccgcgtaggctttcgatacgagtcatcagggcttcaaaacacagttccagacgttcatcaaggatgcgccagaatgcgtcgtgtgcgtcttcttcttcctgcgcttccgcttcaatggcgatgcgtgggaggttgattgtcaccacacccaggttattacgtccatcaagaatttcattaccgttatcatcatgccacacgctaaggaaactgcgacaacccataggagatacaggaacgctagaaccagtaataacacggttgttagctgaactaatgatatctgggtacatgcgtttagaagcacattccagggcaagttgtttgatgtcatagttttgatcctctggatcaaggttaattcctttttccatgaacataaccagtttcgggaataccggagtaataccctctttacccaggccgcgaatacggtttttcagaatcgctttctggatcatgcgttcataatcgctcgtaccagtaccgaaagtgatggtaacaaacggggtttgtccgttggcagtatgtagggtgtttacttcatactcataggactggaacgcatcatacacatctttttcagtcttttcaatcgcatacacatattcattatagtgttcgatgccgtaatgttcagcatcgcgcagatgtttgaagaatgtcatttcgacgtatggagccagcactttatccacgttcgcaaaggttgtccctccgtactggtgagaggcaatctgtgcggtgatctgcgccatgagagcggtagcaacaccgatcgatttaggcggttcaatatcagcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcacgctgtgtcgggaatacccgtgcgtctttgtttgcgttctcgttggtgatctctttgttggacagattcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtaccgccagctttttctacagcaatacggattttttctttatcgaaatcgacgtttttaccgtcgcgtttttctactttcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacaccagaccggatctgttgaatttgtgcttcacaataccttctgtaccgttgcataggttacaaagtaggccgcgcacacgtccggcgttttcgccgtctaaagcatggtcatggtcaaggtgatgtttctcgatctcgccctccaggggacgtttacagatagcacaacagcccccctgtttttcaaagagagcttgcttgatagttgggtagtcttttttggtaattcgtttcgtcagcataataacaacattcagtaaggtgtcattatttattacagggtgcggacgtactcacgaagttggtcgaatccgcctacatgtttcccgtcatggaaaatctgaggcatggtcatccggcgcgtaccaacaagcgcttcgagttcatcgatcaccgcttcgttcagtacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgcagttcatccaggaaagcatataactcacgttcgcgatcttcgttccagaacttgttatacactgcatcggtgatcaggtacggaggatcacagtacacgaaatcattttcacagatatcaatgtcacggaatgaaccactggaaaactcaatgcctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagcccctttgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggcaatagcgattgtttgttacctgtatacgggataacacccaaataactcatagaaaagattccagattgttaacgtatggctgaacacgaagaatagaatcgtgataataattctccatcagttcgaagcctttgaaccgtctgttggttagtatcgacattttcataactgtaccagaaccagagaaaatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggattgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttaattgtggtaatcataattcaccaagtcctttctcaaataaggcgatcgtttcgtacttatacccacgattcaccacgaagcaataattttcgcctagtttctcaagcattgcaatagcacggtgttcatcttttttatctttcagtagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccacccataccgaacgcgatgttctcactcgcccacttgttcgcttccatccaacttaacacacggttgattgtttcaggtccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtagaaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtcagcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcatgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcgtcgtcatcgtcatagccaccccagctatcaatatattctgcttcactcatgttcgatccttatttgctggtcagtaagaagacccggttgtcgctatagtcgatgtagcaatcccaccaaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttaggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgggtatcgaaagtaaacccttcttccgccagccattcacccagatccgcatatgctttttcggtacattcctgatccataaccttaccgataaaacgtttcatatcaaaggtatatgcttgtttagtcggatatttcaggacatactcggaaatgtctttacgggatgcttcgaccattttcgcgttgatttcatcaaccagtttacgcgcacgttccgccagtgtcgggctacgtccacagcggggatcatcttgtgtttcgcgtttgacccacgatgtcccgcttcccgcctgtacgttcacaccgattccattgatttctaccattatgtttcgccttttttaatgcctcttcaacagagaggcgttcgtaattacgtgattgttcgggagttatcaccagagaaaatccagagtaggaggtttagtgttaatccctaaagtatcgcagacttcatccagaacgttttgattccaaaggttgaacgttggaactttatacaatctggcaagccttgcagcgatcgcagtaccacctttaacacaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggctttgtacgtgtcgtattctgtatagtcgatgatatccttaccattagaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatgctcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggcccgtagttacgttcgatttcttctagcgcgtcctgtaccgtaagccccatcacgcgaccgaaatctttagcggtgagattcgcgctgtcaattttggacagaacgtttttcacgcggttttcagtcaggtagcaggtgaattcgttcagcttcactttgtctgtttctgacagttcagaaggagcatcgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacaccgttctttgcagggatcgcaccggagttcgccaggttaaccaccgaatcaaaggtgataggcagtgtgcggatctcgtcaaacgtaccgtatgccagcagtggagccattttcaggccaacagcaacagcgtaatttgcaacaacgttatcagggaggaattcgccattaacacggatatcaaatacgtagaaatctttttcgccgtagtcaacatctttctggacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgctacccacacgccaccagtcaaaccattcatgatcacaccattgatgaatttaccttcataatggttagtcagagaagaatatttcacaaacataattaacccttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacgccaaacccgcttcctggaacgccagcgccatagcgccgttgattgctttacgtttgttatctggacgcggatcgcgtttagctttgagtttaggcttgcgctgttcttcacgatgtttattgatgtacacacgacgcagaacatgtttcacttttggattttctgcgcggaaagcacgaattcgctcaatttcttgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatatacaacatgaaatagtttcatatacaactaacctcattttcgtatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgataaagtaccggatcaccacctattgaacgtgcagcccttccagcatagatacgagccagcccgatatcagcagtgaagaaaacacgatccagatttttctttctgcctttttcagacagaatatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaggaaattacagaaatcgtcaatcagggtatcgcgacgggctttatattttgactggtcgccaagaacagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggtgcgggttctggtaaagggttcaccctcgaaaagctgttaggcatcgaaggtatcacactggacgttgacgcactcaaaaaattggtcatgggtagtaccaaactggcagcagagatcaaagcgaaaactggtcacgatgtcaaaaccatgaacctgaaaaacccagacaacgtagcaacactgcatcatgtgatcgcggacgtgttcaacgtatccaacaaaaaccaggcgcgtgtgtacgcgggtatcgcagcagcaccggaagaccgtaaaccaaatctgatctttgacgtaaccctaaaaagcatgagcaagctggcaagtatcgcccgtgatgttgaaacgctgggttatcagaaagaaaatatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttaacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttacgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagcccaaacaaacagaactgggtaataagcgtttttcatcatttcgtttttcattttgctttccttcttcactgcgagagccattcccccgccttcgagtacaaatatactttaaacgagggtatgagtcaataagtttttttagcaaaaagtgctaaaacttaaatgtttcgaatcggctatttctggtttcgcgaacacgaacttcaccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcaacgatttccggttcaggggaatcgatcagcagttccggtttttcttcatcttccggtaaagcagcaaccagatccgccagcatgttatcgaaggatttttgtttgttcagcttaacagcaaacacagtcattgcgtaatcagctaacgcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaaccgaggatatcacgcaagaagattttaacaagtgggttagcgaacatccggtttatgacggcgacaaacagatcgatccgtactggtatcaacgcgaatccgtgttccacggtatcaagaaccgtcgcggtgttctgaacctgccaacatcagcaggtaaatctctgattcaggggcttatctctcgttggtgtctggaacattacagcgggaaggtgttgatcatcgttccgactaccgcacttgttgaccaaatgatcgaggacattgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggtttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacgacgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccgccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattgatacaggatacgacccaatgctggagcatccttcgcggtgtatgcggtagtaccgtcaaaaataccatccgtaacgagtccatcgacgttgtaacgtttggaaacggtgatcagtgtttgaataatgtctttgttgacttcttcacttgccacggttcccaggatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcgctggtttcatacttagaagtgtcagcggcttcactcaccagacgaattttgctttggaacacagctttcatgatcgcggtgtctttgtcagtatccagagtgttcagggtaatcggtgcgataacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccattagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgaagactgacgcatcaacttgtgaattgtgtagtgtttatcactcatttctttggttcctgaatttatagggagtatattgtttatttatgcaacgaatttccattcaggaaatttgtcactctttaaacggtaatcaaggccagatcgagaaagccccaacgctttagcagcatcagaaccacttgcataaacaactccatctatcgacacagaacggcttattttggccttgtgcgcgtctgtgagcttagatccggttctgtcgaatgcagaacccttatacatagctttgatagtctctgaacgcttcctgttggattcttccgattgcttctttcctgttttgatttttgaaaggcgttcgcgcatttctggagcttgcatagctttcgaagtattttcagaaatcagcttgcgttgttcatcactccatccaatcaatgccattggagcacctttaccaccaataccagcattatatgtatctggtcgatttatgaattcaatatcaactatttccctttccttctcatacatttcttcacgggtgtcaaatacatgaagtatttcttttgtgaaatgttccataccatatttcttttgcgcttttttgattgcaataccggaacccatgtatgaatcgttgatatcttcggttgagtgagcaccaacatatattttgttattgatggtgtttgttattttataaatgatatgtttcataatatagcctcaaatgttttcactatttatataaacaaaaagggaacccgaaggttccctttaaaaagtcgttgtttttcaacaacttaggatcaaagtcccttaacccacacgcggcggaagtatgcgtttttaccgcacatttctttgctgatcataccagaggtgatacgatctgccggagcctgagagcgagagttcgcaaacgggttgataccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggtcacgttctggaagtacgcgataccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctaccgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaatcgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttggtacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgctgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcttgctggaaaatgaaggaaattttgctaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcgccaccaccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgcccgttgtatgtatagccatttttaggagcgctatacacgaaaaattcgcgataacctcggaatactttcacgccaccatcaagggtttcagtgatagattcgcggatcagttccatcgaacgcggatcaagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctggatcgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatccaattcgtcctcacgggcgaagttcttgaaaaagctaagtacattgccaaagcccaaaaagttcatagtaactccgaaaaataatgataggggtattgctacccctgtatttatagcctttattcccaccagtccagcgcgaaagtaacctcaaatgttgacacttcgttgttgctgtcccagtccagggtaacttcgcctacgttagtagggaaaagaccgtggatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacgtgaatttaaagtttttgcccagatacgggatctctacttcgaacaggttcggacgtgcgaaatcaccggattcaaaggcgcgtaaaatgtcagtaagcattttttaacctcggattatttatgggggcttttcagcccccttgacgttatacggcttgcggtcctaccagttcatcgaaatctgcgcccgtagacgttgctacgaagttcagagtgatgtagttgatagaacgaggcggtttcacgtagatcgttgctacaaactcgttacggtcgattacgtccggcgtgttgttcgtggtgtcacagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccatgaagccatagcttgaacttacgttcaggttgttatcaacaacagcaccaccactgagtttatagccagtacgccattcaatcatgttatcaaccgcagttgccagcgggatattcaccagaagtgagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaatgccaccacgacgcacaacaaaagcgtactggttgtcggtctgtggcccgtaggtcattacagaacgaccgctattcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcggaaacaccggaagactgagaaacaatttcggtagtccagccagtagaaatatctgggtaagtaccaatctgtttagcacgggcaacgattttttcgcttgggatgattaccgcgaggatcttgccgttactgtcaactttggacactttaccgttttcttctacaacaacgttgttgtattttactttaatcacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccaaccagcgatcagggttccactggttcccatgaattccgcgcagtgttcctgcaagaatgcctctttgctggagccagcgatcatcttcgcagaccacgaataaccgtcatcaaatgtaccgttgtcgccgtctgtatacaatcgctctttaaccgatgtccagatcgccgtgtaaggcacgaaaccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacaataccaggctgcaagaagtcgggcagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcccttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttttcgtaaacaaccacatcctccccagactcaacgccgccagggagggaatcaatattcagcaattgctgcaaatctaatttttcatccattctcattccctcggcttaggaggttcatcaccagacgggatcggcttatcgtgcgagtacgtctgaatatattcttcgcccgtgtagtcctgcataggcagatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaaatgcggttgaaaatatggcaaaatctgttctgcgatctggaacatatcatcttcatatcgcgtatacacacccagttcgaaaataagacgatacggcacagggttaaactgtgtgatcgtttttcgtggggttgctaactgtgtcattttttggttgaccgcgatactggttttacggattgcgttatattgcagatccaccagtgataagttcatgcgcggtaaaatggtttcggtctttgcaacgttttcctgactcaacgtgtagttgagtttgttcatggaagcgagaaacttctctttcgatgcataggtgatcggaacctttatgtatttttcttgatcgccgcgtactcttttaacctgaacgtgattaaaaagcgcccccatcaggacgatataattacgcagagaactattataccagtagccaaacatttttattttcctgtatgggttgtgggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttaatatcagccagcccgtcaagatttcgaatcggttcgagatccagttctgcatcaggttcaatgtggattccttcatttcgctgcaattcaggagccagttcttcacctgtgtagatgaatttcgcaaggttgattttgcgttgaggacgatcaccgaactgatagaacggatcggcttctacccacgtaatttcaaacaggctattgtccatagggaaataaaccagatcccccagaacaggaataccaccatcagtttgatgtgcgaacaaacgagggttaattaccagcgtcatttcatcgtttgaactcagaccaaatttactaaagaaatctcgttgtccttcatagttggcatacgattcaatatatgcagcaattttccatgacttcgtaaatttggattctcggtcttcgcccaggatcttatcaatattcacgaagtcgcgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatcgaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccatcggttgttatatgcagacgttccgcccgtaacagttgaaccctgtcccgctcgtacaccgcccacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcacctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcagccccatcaggaaatcggtaaaccacggataaaccgctgtaccgtccattgtggtcaatgaacccatgtttgtacgcaataccttcgtgatcgcgaagatgtgctctttgctcaagtcgaacacgttgcgcggattatcatcgcccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattgttcgtaatcatatgatcctcaaaaggggcttgcgccccttgttaaaattatgctaccgtgacagtcgctgttgctgaatcgcttgtgctattcatcgcgtcagttacggttacatggtaaacacccgcatcttcgctggttgtagcagatttaacgatagaagaaccagtttcgccagtcagtacagaaccgtctttataccatacgtaagtgtatggaggtttaccaccactaaacactacttccagagtcaatggttcaccatcagcaacagaaatatcgctcaagtttgtatcgaactgaggaaccgtgtataccgtaatgtcaagttcatcagaagtaatcacggtattttcagcgtcggttacgacaactttatatacgccggaatcactcgttgtgatgttctggatcattacactcggtgaatcagtcccgatatttgcggttcctttcttccactggtacacataaggcagtttaccacctgtaacggtaacagataaagaaatatcatcaccctcgatataatcgttacgaccgaccagattttgagtaaatgacagtggaactttcttcgcttcgtatttgttatccgcttcaacttctgtgatatacggaaccagagcatcagtaacatccttgtgagaggctttattctgttccagatcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcgtcaccataaacagctttacccatcgcgatattagccgcaacgagtccagttgacgtattacccacaattgcggtaacatcaatcagtgcctggtgatcgtcgcgctgtgtgttttccaggttcagaatacggcctttcatgctcgttggctgagagtcagtaccgatatcggtcataacctgtgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatctatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcgtcggttaaatggcctacatctgagtttacccagtcatcttccagcttagtaatacgtgcttcatggatagataccgcctgagcgttagccattaccttgtatttcacgccggagccagtagaggacggatcgacatcaccattttcgttgaagccaggatatgcacccagttcacctttcaggaaaataatatcctttcgaatggtacgatgtttaggatcggttgacgcatcccatacaccaacttctttttcgatatcctgaactttcaaggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcgtttccgccagtacctaatgctttgctgtaatcgttattcaggtgcataacacgttggtcattcttttctgcgcctttcagttcataaactgcttgactcttaggaagattaccgccgttctggtaaatcatctggagatcatgttcgtgatacgcaaacatatcagcctgatatgtaccaaaaccgcgacctgcatccaaaccacgcccaccatcaaagccgcgagctacaagaccgcgcatatcaggcaagttgaaaatatcaccagaaccgccgtatgtataaccaattcgggcaaacagttctgggtttgaattgcggttcatcgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacccgcgcgaacttctgcaactgttgctaactgaacaagaccaaacgaactttctgttgcgtttgactgtaccggaaccagagcagagattgcctgtttcactttaagcggagtcattgcggtagtgtcatcagtaccggacgttgcctgagcagttgttgacagtttcgcagaaccccaaacgttttcttttgcctgacgggtgttaaacacatagttcaacgagcgcggagtaagagaaaccagatcgtttgttactgttactgattctacatcagttgcgtaacgagtgtaaccccatacggtttgtgatgcatgagggttttgcaaacgatacgccagcaaagccggagttacaatcgtctgtgtgtcagtacccgcgtcaatcattgcctgtgtcgcaatagcagcaataccgcgcacaccaggcgcggcattaggcaatccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccatattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgccgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatggggatctgttgagacaaagaatacaggtcatcaattgctgattgtacgttagggtaatctaccccttttcgaagctgatcgacgtttgcaccaccaatagtacgtttaccgccaatcagcggttctttcgtacccatttcatattgcaaaaagtctgctttgcgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccgtccagatcgttattgttcagaccaaaatcgctatccgatgcatcggttgtccaacctgcaaggaacataccttccgcgtaacgtgtccagataccaaagcccatataatcacctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcggtatattcaatctgattaaccagcgtcacttcttcttcgttgttcaggtaaatcttatcggtgtgttctttaataccgcctacaccgtcccattccatgacagtaccgatatcattgttgaaccagcgaatagttaccacatcacgggattccagaggttgagcaaatttaatacccgtaaccacggagttaacaaaaatcagactgtaatcctgtccagaaggaacccatgcgccggagttcgcaatacagctactttcatcataaccttctgcgccctcacaaacaaatgtcgggagatccgcatcacctgctttaacaagctggcgaccgttcaacagtagttcgaacgagtttgggttaatcaaaattcggggactgatcccaaattcagcattagtaaacgtgcgtttagttgataaatcaccaacccagatttcaccagggatactaacctgttctgtgtcgcccgtgttatatacgcgcatggtatgcgcttcatacgtcgctcgccatgcagcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgctcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataattcggtaaagttggcgttagtcttctgaccaccacgacgcagataatcacccgcgccgtcatcaaccacgttaccgataagaatttcttgtttcatgctgcgatccctgatttaatggtgtcaaccgctttaatcgagaatttaatgcgattctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccctcgccaggtttacccgatggaagcacaaccgtaattggccctgtagaggtatccatatcatgcagtgaacctagttcaatcgggtttcctgaataataggttcgcggtaatttctggaaatatccggtcgcgtggagtaacattgtacccacaccatcattcgcagtcagtaaacgcacatcaccaaacgcattgtatacgttggtgatgatttcgttaagtttaacaccgccgtcatacagcgggtcaccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgcctcgttgcttttacttctgggtcggatggttgcgcctttttcaacagcgggtttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccgg

SEQ ID NO: 158 - DNA, 43499 bp, Unknown
  source: /note="Description of Unknown: MCoc15c Bacteriophage Sequence"
aatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggggttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgggcagggttgcgggttattatcttgacggggcgctcggatatagtaagagcggaaacagaggcctggcttgagcggaacttcgttatgtactccgagctggttatgaggccgcacagcgacaaccgaaaggatactgtcatcaaagaggaatttctgcgtaaccaagtcgggctggaaaacattgtggcggcttgggacgacagccccgcggtgattgagcatttccgcggactgggtattaccacttacgctgtatgcgactatggtgcagcaacacatcgaacagacttaaaatcccacggggtggaggaattagcatgagtgcagtaggtacaggcatgaagtatgacgcaggcaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacagcacacgctctaggggaaacactggactcggagagtgggttgccgcacctggcgcacgccgcttgttgtgcgttatttattctagaactggagcagatggatagtgcggccgagtgagtggtgccacatgatgtggcagaaagcagtagagcgaggcgacgaacgcggcgctaaaaactacctggagatgtataatctctgggtaagtcgaaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgcgcgcgtaagctgattacggacgcgttgcagaacggtgggattatgaacctgccgatgacgcagcgtatgctcacctcggcatacgaggtggctgctaccgctatcgacgagatgcgaaatgtcaaagccccgggcatcggtggtaagtaccgccggttcctgcgcttagtacccttggatgtcctgaccaccctgagcctgtgcacaatgtttgaggcgttcagtgtcgccccaggcgagtccgctagtcgccgccagactgcacaggcggtaatgtctgcgctgggccggaacgtgcagtcagagctactggctctgcagttacgcaacgtagccccagcgtacatggaccgcgtgtatgagtacctcacagagcgccgtacgaagtcccctacgcacatcctgcgtacgctccgtgccagtgccgagaacgtacactacgggcacgagccttggaccaatgcccagaacatctccgtagggcgtctgctgtgtgccgcagtgtttgagacgggactgttccagtggaagaactgtagcgggaatctgagcatgctctatccggctgatgacgttatggaggccttccagaaactggtagagtccgctgatactgtaaccatgaagccgcctatgctgataccgccggtgcagcacactactctgtgggatggtgggtacctcacccctatcgacaatcgcggaacctaccataacgcgcacattgacagagctcgtctccgtgaagtagcggaagcatttaagtccgcggacggcatcaaaaaagcgcttaataaggcacaggaaaccccgtaccgtattaataagcgcgtactggaactggtgcaagaagcacgggccctgggtgttgggataggtatgcctcgctcagtaccggagccgaaaccggagtggtatctggacggggttccgaaagagaattacactgaggaagagcttgaccgcttcggtgagtggaagacgcgtatgtctctatggtatagcgccgaccgtaagcgtgtatcgcaactgcgcagccttctgactacgttggaaatggctgaggaattcaaagatgagaaagccctgtacttcccgacttgtgcggactggcgctaccgcctgtacttcaagtcctctctgcatccccagggttctgatttgcagaaagccctccttgaatttggtaggggcaagccgctgggggagcgtggcctgttctggctcaaggtgcatatcgccaattgctttggttatgacaaaaccctattcgaagaccgtgcagattgggttgatgcaaatattggtcaaatacgagagttggtacacaatccatttagttcggatgcttttaggtcggccgactcgccgtggtgcttgttggcagcggctacagaccttgttgctgcacttgattctgcgtgcccagaagagtatattagccgaatcccagtggctatggacgctacgaactcaggtgggcagcacctctcagcgctcctgagagaccctgtgggcggtcgtctgacgaacctgtactgggagggtaatgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctggctccgcgtatgcgcgccgctatcgaggaggcaaaccctgctgctgcggcagttatgtcgtacttgcagaacctagctagacgtgtaccggcaagccagcacctgcagtggtatacgccgctgggtgggcttgtaatgaaccgctacacacagcgtgaagaagtgcgtgtacgtattgactgtatgaatctcactgtcatgcgagtgcataatcgagattttaagacatgcaacaagcgtaaggcggcctccgggattgccccaaactttgtgcatagcctggatagtacgcacttgatgatggtgctctgcgctgcggaggggttggatattgtacctattcacgactcgctggctactcacgcagccgacgttgatgctatgcaccgacacatccgtgaacagtttgtgcgtctctacgaagagaatgacctgcttggggatattactcgcgcagcagcagcagccggggcggacttgacggacctggatatgcccgaggtgggtactctggacatccggcaagtactggaatcgcctttcttcttctgctgataaatgaagttaccggagtaggaatgaagttaaaacacactagtaaaacttccgattacactctcaaggttctgtataagtctgacgacattacagacgcagtgaggcaactgcacgaactgggccacggcattagtcggggcctagctccagagcagcactactggagagtactgggcagcatactgggtaaacagtatatactaggagtctatgactcccaaggcgacttagtcggtgctgtcagctactacccagaagctgtagaggactgtcattacgtagagcctgtgctgtatacagacttcttcgtattgaagccaggtaacagtaaggcggtacttgtgattatgcagggccttcgcgcaatagctaagagtatgcgggctgggcgtatcgccattagccgaggtgcatcggataacacatacaatacaacttatcatttagtgaggtcagaatgagtggtggtttaggtaaactgttaggcaaggccacggatatgctcggccttacggacaacgcaggattagaggcgcagcagcgcttggcagagcagcaggctagcgcagcgaaacaacaggctgccctagaggctaatagcgccgcagataacattgcggagattgaccccgcaggggctgcctctgcatctgcagatgcaattacgtctgagcagaagaaacgacgacaagcagggcagagcaatcctctgggcctgtaagggggtagcttggaacaaaaagcaacattagcagaactctttaagaaggaccaggacgcaggcgtcttggatgcctctgagaagttcgcgcagtggacactcagcactatctttacccgggacgattccctggacggtagacgcaggcctctggagcgtgactaccagagcaccggcgcgcagctggtcaacactgcagccactaagattgtagggtcactgttcccgcaaggcactagtttcttccggttctccaagagttcggacctggacgagttcattagttcgctgggtagtgcagctacagcagaatctaagctggctgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagtgggaacgtcctgcgactcattatcagagagcgcgcaagcatccaggacctgccagaagatttccgcggcaccttctaccgtgacaaagacccatacggcgacgttgatatctacactgccgcttgtcgcaaggttaagcggacagaggaaggcgtagaggtagtaagctacgaggtgtaccaagaagcagacggacaccgtattggggacagcagcacctatccggagctggaacttccatacaacgtgctggtgtggaaccttgttagcggcgagcactacggacgcggcttggtagaggactacgccggggactttgctcggttgtcggtactatcggaagcattaactaactacgaggttgagtctgcgcggttaatcccgctggttgacgcaagttccggtctggatgtagatgagttcgcaacgtcggagacgggcgaggctgtgcaggtgggcggcggtggttccaacgggaacagcaaatcccccgtcactgcttacgagggcggctctgcccagaagattcagtggattgccagcaacatccagatgctcgaacagaaactatcgcgtgcgtttatgtacactggtaactccaggcagggtgagcgtgtcacggcttacgagattcgccagaatgccaaagaggcggaagccgctatgggtggtgggttcagtatcctgagcgacacctggctgcgtaagctggcgtacttgtacactgcgctggcgtaccctcgctttaagctgtacctcagcgaaggcgtagtgagcatcaacgttactgttggcacctctgcactagctaaagccgcggcagcggacaagctgttagaggcggcgcagtccatgcagctggctatccctgtgctggagcagattactccacgcttcaacaaggatgcgtgcgtagactggtacttcgacgcctatggtatcgtcagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaaccgaggcatagatggataacgtagaaaacggtcagaacgtagaaactacacaggtagagaaccaaggtggccctaagattccgggcctaggtgctccccttaacgcccctaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggcaaggccctggagtatcaggaccctaacctaatcgatacgaccttcattaaggaacgtttcggagagcacgctgcttatgcagagttgctggctaaagcgtacctggaagaccaggttggtcaagccaccaaagcagtacaggaagcttacgatatcgtgggcggtaaggagaactgggaggtagcagcgcagctgtttaattccaaggcccctgaacctcttcgtaacgcggctcgtgtactcgctaactcgggtgagctcaagcaggccgctgagttggtagcaagcttctgccgggatatgggtcttatcaagacacagaacccaatggtacggggcgtggccagcaacaatgcactgtctgctgcagaattccgcgcagaatataccaaactccgtcaggaagcgggcaaccgtagcttggcgtccccacagttcagtcaacgttataacgatttgctcgcacgccgtgaagctggtaagcgcgtaggtctttaattttatttataaaggaaactaaagcatggccaacactatttataatggcaacctgactcgtccgcactggggcggagcggcgtctgacgtagatattcaccttgaagtgtatcagaacgaagtggatacccgcttccagtaccaggctctgttcctgggcctctccagccagcgctctatcagtggctctaacacctaccgtatcgaccgcctgaatacctcctcggtgaaaggtcgtcgctccggtgaggcgctggatagcactccggtccgtaacgataagatgattatcgtggtggatacggtgctgtatatccgtaacccgattgactaccaggatgactggaccggtccggacttcctgaccgagatgggtcagaacaacggctctgagttcgcagagaccttcgaccaggcgcacctgattcagctcatcaagggccgctcctgggttgctccggcgcacctgaaaccggcgttcaacgacggtatcgaggtaggcgcagctattctggttccgggtgccaccccttccacgcagctgacccaggctgagatggaggcgaacgccatgaacattaacctggcccacaaggctggtattgatgaactcatcaagcgcaaaaccccgctggcggatatgattaccctggtggatgtcgatacctattcgcgtctgctggagcatccgaagctcctgaacctggactttggtgcatccaacaacgacggttacaaagaccgccgtgtagtgaagatgaacggagtgcctgtagtagagtgcacggagttcccgaccgctgctggtacgcacccgctgggctctgcttacaccgtcacctctgacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacatcggcctgcgtcgtccggacaccgctgcagtgaccaagttcaccttcaccaccaagtcctaattggaggttcaatggcagtaattgctacgttcggtctggagaccctccaggctaatgcagctcagcgggaggcggttaaggccgccaccgatgtagcgaagaacatccaggtggcttcggttgaatctggccgcaaggctaccaagaaaacccgtaaggcggctgacgtagccgctgatactacggaagagtaatacgcgcccctggtgccttcgggtgccaggggctttttttttgtccctgtcttaagggtccaaggggtctttaatggaggaacaaatatgagagaattagatgctgtgaacctgacgctggaagccttgggggaatctcgcgttatggacatcaacaccagtaacccgagtgcggggttagctcgctctgcgcttgcacgcaatcgtcgcgggttactcagcacggggttctggtttaacgtggtcgagcgcgaagttacccccaccactgacggcctgattaaggtgccgtggaaccagctggccgtgtacgatgcctgctcagactccaagtacggggtacgtgacgggaacctgtacgacctggtagagcagaaccaatacttcgatacgcctgtacgtattcgcgtggtcctggatttagcctttgaggacctaccggagcacgccgctatgtgggtggctaactacaccactgcacaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgcgctcgttttatggtttaaggagaggttatggcgcaatcattagaaggtaccattcagagcctactgcagggcgtctcccagcaggttccaagagagcgccagcccgggcaactgggggcgcagctgaatatgctcagcgacccggtttccggtatccgccgtagaccgccgggtgagattgtctgggaaagcacgatagataaccctgggcttgactccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagtattgctggattgacttatatcctgaatactgagatggctccgaacacaaccgtggacaatactgggcgcatcgaccccagtaccaccgggttcttctacgttaaatccgcagcattccagaaacgctggaacgtcaccgttacctctgcaggggtagactactcaggggactacaccgccccagctgctggtagtaccagcggtaacgctgaggaggtatctggtgcttacgttgctcagcaactgcgtgactctcttgtagcgaatgggttgccagctgggaacgtgagcgtacgtggcgcgtacctgttcttctatgggttaagcaactgtgtggtatcctctgacgcgggtgatacttacgctgtggtgtccaaccagtctcgtgtagaccaggagcaggacctgcctgcacagctcccagcgcaagctgacggagcaatgtgtcgtgtgggtaccgcctcgtctgagacagcatggtaccagttcagctacagcacccgcacctggtctgaggtgggggcgtatggtagcatcactaagattacgaacatgcctagagagctcgccgcggatgacaacatcatcgcgcgggattgggagggacgtttagctggcaacgacgacaacaacagcgacccggggttcgtagagaacggctacatcaccggaattgcagctttccagggccgcctggttctgcttagcggcagctctgtggatatgtcagcctctggtctgtatcagcgcttctaccgctctactgtgacgtcactgctggatacggaccgtatcagcattagctctgcgtctgcccaggattctgtgtaccgcaccgctgtgcagttcaaccgggacttggtcctgtttgctaacagcatgcaggccgttgtaccgggctctgcagtgcttacgcccaccaacgcaagcattagcattaccagcacctatgattgtgacagccgtgttaccccggtaatggcgggtcagacagtaatctacccgaacaagcgcaacgacagctacgcgggtatattggagctaatcccgtcgccgtacaccgctgcgcagtacactacgcaggatgccacggtgcacctacctcggtatatcccaggcagggtattgcagatgcaaaactccagtgtcaccaatatggccttctcgcgcatgtctggagagcgtaatagcctgctggtctacgagttcatgtggggcggaagtgacggcgctaagatgcaggcagcgtggcataagtggtcgttcccgtacccaatcctgagcgtacaggcgctggaggacgaggtgttcttgtacatgcaagggcccagtcccagcaacaagctcctgattgtgtctatggacccgcgtgaaggttatcagttgggttcagagtaccgcgaagcctactcggatttgcagaagcaagttcaagtacagggaggggtgttcactgttccggcggtattgcgcccggttgggtgggcggacaactacaaggaagagcttatcctaacgtacttacccggcaaccctatggggcctactgaggtcggcatcaaggagattgccggggagaacaccctacgggttgtgcgcggcgtacctgatggcacttatgtaatcgggagacgttaccgtagtactttcacgctaactacgcctattctacgggaccagaatgacaagctcgttggaagtgggcatgtgcgcctgctgcgtctggatgtagcggtgcgtaactctgggcacttcgatgtacaggtactagacaccccgcgggacgtcaattggggcggggaactgactggtatcctgatgaactcaaaggagctgacgcttgggcaggctctgcgtatggacccggctacgattaccgtgccatgtcgtaccaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactacaggctgcagcctctgggactatgggggcctcggttaaagacgctgtagccacagtgaacactgtagccgggcggcaagaggccagtgtgcgcgaccagcaggcaactcaggaagagggcttccgtctaatgacagataaggctgtggatagcggcctggctaacatggatatggaggacccgtacgataatatgtttaactcgctgttgagtgtcggggcatccgctgttgggcagtacgccggtaacgctgcgtcatcttctgactctggcagctcttcgcctggtagcggagcgtcagctacgcagagcatggcatcctcctatgacttatgggggagtaagggcaatagcccagttcacacctggtaaattaggaggaatactaaatgcctgtgattcaacccggtagacaggggttaaatatcggaggagtgcaactgcagtccaacgatgttagcttaccgtcaacggtaagtgaagtatctgttgatacctccaaagcaaaacgcctagccgccctgtcagggttcgtgcaggacttcggcgtaggtttcgacgaggcagtaaaagaaaacgccgcagccgccaccgtgcgcggcgctatggatgctcagggcgcagtagatgcaatggcctccaaggacgaggctgtacagaagcaaaacatcttcgtgcgcgaagcctaccaggacggctacgtatccgccgcagcgtacgacactctagccaagtggcgcacagacagcatcgcccgggctaagaaagctgccgaggcagggctgactgacgaggaattccagcagcaggagcaagagcacgtacagtcaatgtcagacaagctcgggatgtatctcccggatatgtccaagcagtctgctacgagtatactgcagcagctccgcgctaccagtatggctaactatacagccttccagaaaggacgtgctgcgttcgccctggcccaggctgaccgtgccctcgaccgtgggctgagtgcgtccagtgatgagttctatcagcgcctgcaggcaggacagggtgccgctgcgcagatgtctatcaagaccggattagacagtatcctggctgctgagcacttggacaagaacaagaagctggaccgagccaagcagtatctggttagcgtagcgcagcagacgcaggacccgctggcaatcaaccagctgcaggaaatggccaccaaggaactcggcgtcaactccgtggatgtaaacgcggcgctgtatcaggagttcaagcgcgccggtgctcagattgagacccaagctcgtttcgaaatctccgatgcaatccagtctctcgaaggtcagaccccagagcagcaggaacagactatgcagcgtattcgtagtcgtgtcattgagctgtcggcatctgatgtacttagcgccgggaccagcatggagttctggaacaaggctcagaccattcgagagaaggcagcagacgcccaagcattgcgcacagcaattactgggaatatgccaagctccactctggcagggatgttcaagggtgacttagataaggcacgtacgcagttactcaagaatttcccagacactccagaagggaacttgcagctgctggcatacggaagcaacagcaaggatgcgtgggccgtcaacgaagcgcacaagcgtatgtcttcggatatggcacgtacgctgactacgctggaccagctcggtgaggacggtgaggtttcccgggagaacgtcaacagcatcaacttgtgggcacaagcttatagcaccagtacggacttagggaagatggcgctactgtctgaggttccatctgagtggcgtggagtggtgcagaaagctgttacacaaaacccaaataatgccagcaacactatcttggacgaccttcgccgccaggctaggaataaggcgagtgggcgctacagcaatattcaaagtaaccccacggacaagatggtggacccaagcggcacggctaactggttcagcttcttcggggatgcagacgcccagcgccaggaagcgcgagctgctatggaagacgagtaccgttatgtgtataaccacaatccggaatcccttgtagggaaggacgctgacgacatcaatacgatgctaaaaggcaatatccaatcccgtaagctggagctggacattgctggggcacctaggcatgtgtatctgcccgctggcacctctgtgcaatctatcatgggggattataagggtgaccaagagcaattcaaggcctccctgcagcagcatatacagaaccaggttcagtatatgtcagaccccagcaacatagagcgtgtagtagtgcaggccgccaccgcgggcaacgcaggtcagaacatgaccgtaaccgtgttcgacaagaagggcgcattccagactatgtctgtgaaccttcgagacgttcaggctactgcacaggctgcgtatgactcggcactagctggcgagatgaagattggcagcgaacaagtaggcgtacgtcccgctaccttctatgaccacgacaacggacgtgctgtcagcgtgcaagtcaacggtcgtaactcggtggggctggaaccatcactgtttagtgacattctcgccaccactatgaagttcgaagggttccgagaaggtaaaggcaagggtagtgtaggcttcggtctgcatgttaactcgggcatgcccgtcccacagaaagtgaccattgatgacggcatcagtatcctcaagtcctccatggagaagcagtacataccgaacgtgcagaagcaactcaaggggcagggtttgaatgcctccgacgaggcgttaaaggtaatggtggacctgaactatcacggtggtaacggtagctccggccctgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgagcgtaagaagtacctggaacaaaacctacgcgattggctctttgaagcaacgcactaactagaggcccttcggggcctccccttatcaaaattcttttaggagatattatggctcagtttctgaaccaagaaccgaatccacaggaaaaggattctgctaagggcgcaacacttaaacctgcgcctgagcgcgtagattggaacgatgccggggacaacggtctgaacgcactggagcgtgcctcattactggcacaggccaagacaccagctactacagccgcagagagctttgcatcgggtatgggtaacagcatcattgccgccgctatacgtaaggcctctgctccggcatttgaccgagacccgaactttaatgctaagcagaccctgagtagcgatactcgggctaaattgtatgctccgaatcaggaagagattgagtacctgcacgactctgtgtcggtagaagattacaactaccgcatgcagcagatgcttgagcagcgtgaccgtgaccgcttaatggcagacaacacagtggctgggttcgcaggtatgctggtaggtgactccccgtttatcctagccccgatgtctgctgctggtattgctggccgtgcgggcttagctgcacgtactgctatccgtgctgctgacgtagggtctgcattctatgcacaggaccaactgggccagtccgccgcggtaactgcactgatagcgggcgtagctgggttagaccagctctgggatatgtctagggctgctaaagctgccgctaaggcgcgtactgggcatgagcctatgttcgacccagaagcgcctacaacgcgtacagctagggatgctaatgttaccggagtaggagagggagaggaaatcctcactaagacactggatgaaagcatccaagtatctagaaacaataccgcctccgtgaacatgaaagcacagcacgtagttcagttcttgaagaagtctgagcacttgacagcaggacagaaggctattctggacacgttgggcgatgctgtaaatgacattgattttaaactggtagcaggctccgcaaaccgtagccgctacacttacgcacaacaagatttagctaagcgtggggagatatccctgcgcgcgcctaagcaagctaacggcagcacctggactacagtcggtgatgcgctgcgcgctatggatgcagatacaagcaaggtggccgtgcacgaactgattcatgccgctactgcgcgcgccattgacagtaatcccgagattgctaaacgcctggaggaagtgcgcgctgttattgcagctgactccactttgacaccgcgtatgcgatattacgctagtagtgtgcacgagatgctggcaggcttaggtgacagccctgagtgggttgagcacctggcacgtacgcagtctcccaccggtaagagcatgctccgccaactgggtgagtacatcatgaacgctctgggcatcaaggccaaaggctctgccttggaggatgtcctggatgcatacgaggacgccgttaagtggaccgctaaggattatgcagaccaagcccagagcttccgtagcgaagccttccaggacctggcggatagcaccaccctcaacgaggctaagcgcgcccaagctatgctagacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgctcgtgccagcgtagtggaagatgctatactgggcgcattgagggataagggtgtaggcgtactctcacgcttcttccatcgtagtaatttccgcgctgagcgggctgcgctggaagaccgcctgagcaagtacctggatgccgcttatagcgccgacgtaaacggtcgcgctgttccggtgccggatgcagagattgctccgttggttgatgcctaccgtcgctctggctgggctagcaagtggcacgagcatatgctcaatgccggtctagtggatgatggtgcgttggttaaatccgactactacttcccgcgccagtacagctatgacaagatgcgtcaaggtatcgcacagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatctcctgcgcggaacctgcgtcagcgtactcggttcaacatggacaaagagtacctgattaacggaaagagcatgcgcatgcaggacctgatggatactgatgtagccaaggttatgcacgggtacactaaccgtatgtctggacgtgtgggtatggcctatgcaggcgtacaggacctgggccagctagctaagatgattgatgagtctaagcatgcactggcggactccgctaagtgggagaagaccgtcaacgacaccatcgactttatcctgggcggagcacccgctgacgctggacagcttccggatttgctgcgtgcagccgggaacatggctaacgccaccatgctcaagaactccgggctgtatcagttgactgatactgctttggctatgaaggagttcggcatggctagggtgctgcgcagtatgcgagaccagccttggttcaaggaaggtgccgtagctatcaagaccccagatatggcttctcgtctagacaccgtgctgcgaggtaatatccagaaggagatgcgcttccgctggctgaatacgtacgctgacgataacctggacctgacccgtcaggcctcctggttcaacgtcactcagaacgttgggcaggctgcacgtcacgtcaacggcatgagtatggtgcaccggctgcaggttaacctgaactccggtatcgtggcagacgagcttacgcagatgttcaagggcgatgctgaggcgtttaagcgtctggagcgtttcgggcttacccgcgaaattgcagaccgtgctatcgctgccaacaaggctaacccgggcgccatgttccagccggacctgcagatacaagttgaggttgtagggacgcgtatgatggactacctggtacagcaggttcgtactggagagacctcacactttgcacagttcaaccctattggcaaagtcattgtagggtaccagagcttcgcactggctgccactaacaagattctgcgtagagagctgaacgatgctgggtggattggcgtagcccacattatggcgtaccagttcccgttaatgctgctggctactatggctaagcatggcatggacgggaaggacgtggacacccagaaactcatcggcgagtccgtaatgggtatgagtgccatcggcgggatatccttactgcaggatatcttcctgggagattctcctcgtcactcattagcatctatgggttacgtcacagggctgcttggagcggtgcaggacctggctaccggtaatatggatatcaagaccttcactaagcaggtcccgttaatccaggaattcgcacctacgcgagctataatcaataacttcggagacgattaatatggcattcagctggcaagagcaaatcaagccagctggtacccaggatatccagtgtgatattgagtatttggacaagtcctatattcatgtatatctcgacggcgttgaaaccactggatacacttggaccagctccactaatatcagactaaatacagccttggcagcaagcacgactgtgctgctaatccgtaagacagagcgagagtatctgtacatcgagttcgcaagcggctctccgttcatcgaggtaaacgtagattctcaaaatacccagttcttgcacctggctcaagagctggtagagggcagggctatccccggattctacggggatataagcatgaatgggtatcgcattactaacatagcggacccgacaggccctcaggatgccgcgaccaagaactatgtagatgttggtgatgctaggcttgacgcgcgcattgactcagaacactcagcctgggtatccgccgtgcagacagaggcggctatccggaaggcagtggacgacgcactgagcgcccgtacttccgctttggagaacacctttataagcggggtagagacagttagctacccgtggagcacggtgctgaccgaggatacggacgaagtgactcctggcctagcattcaccaaggctgtagtggagattaacggggttgggcagattcgcggttacagtttcgagattgtagataatacgatactctttgcagagacattacctgcaggaactattgtagccgcccgactgggggtcgacgtaactgcgggggacggattcgctacacaagcatccgtagattacttggccgactccttggggaatttggcgtatctggataaagccacggctgtatctgatgcaacaggtactggagacgtagtggctcaactaaatgcgctgctggcagcactacgcactagtggggtgctaggaacgtaacaggagaaagtatggcaggggcggctaaacgtagtcgcctctcagagctgcaccgcatgttcactgaggccttgattgaagaaatcaagcagtctaaggaagatgaggtgccgctccccgccgcagataagtcagttatcgctaagttcttgaaggacaatgacatcaccgcggatgcagattccgaggagatgcaggaccttcgcgacgagttcgatgacgaactagcggcgcgcagagaggcgcgtaagaaagagattttaaacaagattagtggttcagattctgaggacttactagaaggaattgtctaatggtatcggtgaagactgcgcgaagactgcgcatgctcaaccagaaacttactggttatagcgcgaatccgcgcagtattcccaaagaggagcgcgaggacatcgcgatgatgatggccgcggcgctgagtgacttccgggaatttgcgtacatcggtatgcggttcctgggctttacgctcacggacatgcaggccgacattgcagagtacatgcagaagggccctaggaagcgcatggtggctgcgcagcgtggtgaggctaagtctacactggcagcactctacgccgtctggaggcttatccaggaccaatcctgccgtatcctgattgtgtccggcgcggagaagcaggcgtccgatgtagctaacttaatcattcgtatgctggaaacctggccgctgctgtgctacttgaaggctgaccctactcgtggggaccgtacttcattcgaaggttacgatgttaactgcgacctgaaacctctggataagtccgccagcgtagcctgtgtaggtataaccgcatccttgcagggtaaacgtgcggacctgttgattccagacgatatcgagaccactaagaacggcttaacgcaaacccagcgtgagcagctgctgatgatttctaaagacttcgcagctatctgtacgcacggggatacgctgtacctgggtacaccgcagaccaaggacagtatctacaaaaccctgccgggacgtggcttcgaggtccgcgtgtggccggggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcgctgattgagaaggagctggactttggtccggaaggcttccagctgcagtatatgctcgacaccacactgtccgaccagatgcgtacgcgcatcaagctttcggatatgctggtttactctggcagccaggattcctccccggagacgttctcctacatcgcggaccgccggtacctgtaccagcacgagcatgaggggattatgggtcagcagatgtacttcccggcattctatggggacatgcacctgccgtaccagcataaggtgctggtggtggacccggccggttgtggcggagatgaagtgtcctacgctgctggtggtgctgcgaactcgtacattcacctattctccgtaggcggcttccaaggaggtatcagcgaagagaacattgataaactgattgacctgtgcgtagagttagacatcccggatatggtggtggagagcaacatggggcacggtaccgtgtctatgcttatcctgaaccggttacgggagcggcgtctcgccggtattggtgtacgggacctgaacaactccacgcagaaagagcgtcgtatcatcgacacaatcagcccagttactcgccgccaccgcctggtagtgcatgagcgtgctattcacgatgatatcagcacttgtatggcgtacccccgggataggcgttggctgtactctgcgttcgcgcagctgtccggcatcacgtacgaccgcggtagcctggctaaagatgaccgggcagacgcaatagccatgatggtggctacgctgaacgggcatctggtggaagatgagaaagtggtggctgagcgtgagtccgagaagatggctcgggccttcattgagaacccgctggattgggcacagagcaaagtgtctaagggccttcggggtgtagctgctcggctgcagaaccgcggcagaggtaaacaacatagaggaagaagataatggcatcaatcatcgcagctaaagctgtggatgtacagtatgagattgtgggtaaggcccagaatctggagaagcaagtatctccagactacaacgtgggctttgtcggcaccgcggccctagacactctgaatacgttctttacgtatatggagggtcagggctataccgccaccgcggaaggcgctagcttcgttgctgacggcacgctacaggctcgtctattcagtatgctgtcgcagctgagcaagaccggctacgttgcgctgactggcactggtatgccattgggtgagggttcaggtaccgactttgatacctcattcaccgccctgcaatctgcatttgaggctgctacagtagcggcagaagctgaataataaaccaaaggagagtacacatggcaattgcaaaagcaaccccagcgcaacagcaggagctgctgcgccagctgaacattctcggtaaggacctatatgctatccttacgcagccgcagaacgtggcccagaccggtgctgccttcgataccaagattgctgcacttgaagccgcggtagccgcagtgaaggcggcaagctaatgcgtaaactggtcgctgggttactgctcgcggttactttgactggttgctcggcgacctctgcactcaccggcttagttggttctaagccggatgtatctgctcaggttggtgccgaaaacaccaagcaaaccgttggcctgaacaacaaggtggactccagcaccaccaacaaaaccgatgtatcagattctaacgtaggcactttggatacgtccagcaagaagcaggtgcaaactattagcacggggacaatccaggcagaacgcttacaggtagttaacaatgatagttacagtcttatcctcgccggattagctggggccagcattcctctggtcttcctagtggtcattctggtgattcgtaagctattcaggaagaaggggcagcaggatgattaaggtaggggacatggttgggccggacctcgctacccgggcaggcgcagcagttactggcgctacggtatcaggaggttggttggcagagttaatgagctggaactggagcactatcagcttcatcactgcgacggtgtgcgcggtgctaaccctggcgtggaatgcgtattacaagcggcgtacattcaagctcctagaggagcaggcacgtaaggggactattaaatatgagtttaaggactaaggttattgcggccctcacgggggccactatgctcggaggcgccattaccggcgtagtgcagcacaacgagggtctgagccttaccacctacaaggatagcgcaggtgtccccactatatgctatggcgagacaaagggcgttaaaatgggccagagagccacgctgagcgattgtcagaagcagctaatacaatcagcaggggaacacgcaaaggctcttgacgggcttcctatgcagctctctgacgtagccctggttgggtctgtagacttcatttataatgtaggcgtagctggcttcaacggtagcgccgtgaagcggcatctcaagagcctggattatgcagcagcagggaaggccgtactggactggcgctatattagcaaataccagcagaaatcccccggcaccggttgggtgtacaagggcagcaaccgctggaccttcgactgctcccagtatattaatgggcagcgcaataaagtgtgctggggcctatgggagcgcaggcagtggcagagcaaagccattgggaaccagtacaagaatgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttctggtaactatgcagccgctattgagcggatttccgctaaaggtgtaaaggtgctgcgagtacctgtggggtcttattatgttggagactgccaccttactaaccctatgctgtttataggtgatggcctagagggcgttaacccgcttggggctgtattcgttaaaccgagcacagccagtaagatgttctactttgacggtacgagcacccgtggaatgggcggcgggttccttagaatgcgactgcagggggctgtcagcagtgattcgggacttatggtggaggtaacgtcctggagctattttggggcggaaaactctgcttttaataacttggcgggctctgcgctggtgttgcgtgactgtatggagagtcacatctccggaaacttattccgtaggatgggtgcctctaacggcagcgttatactcctcggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactagactttggacagctgtcacgctcttggattacccgtaacggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaaccctcctcgcgtatacagtgggaacatgaacgtagtgcgcggggatagtccgttcggccctgggtttatcgggcaggcgtacatgcgcggggctgctgctgctagtcgtaccgttagggctggagccgctagtaccgtggcactagatgtccctgcgggccaggagatgcgtcggtaccagttgccactgcaccttctcggggctatagtgcgcgtatccttgcgagtctacaatcccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgtgctcgttctgttccatttagctttgcgtggaccccaggtgctgtcgctgctggtacgctggtatctagtcctgtgcaaaccctgccgtacggcattactcaagcccctgtcggtttgagttctccggtatttaacgggtctgttgatgggctgctagccggtatcagtagctacagcgggtacagctcctacaaagttactctgtttaatcctggggctactccaattacccctggggctactcgggctagcttggtgttgcacttctaatgcacagcgtaaaacccaggcccagtctaggcgagcaggtctatacctggacctgaaatttattagactcacgcgagcccctccctcaccctcaacgcgcccaattgcccccatagggggtgcctagcgtcaatttagggggggggggcactgctagggcctgctagtgcgcaccagcgggcctcagcgggcctgtgctgcgttctagggctatcgctagtgctaccctatggctatccctgtgcgttcactagggcgcttcctgtgcgctctacggggcgctggggctatccctgtgcgctccctgtgggccataggggtgcgccatgccttgcttattttgtgcgtccattgcgggcctgcctagtgcctgcctagtgggaccagtagtgccgccgtagtgggccagctagtgcgctgtagtgctatccccggtgctatccctagtacgcactaggctatccactggctatcgctagtgctttacattgtgctgattatatgctacgctgcgcgctccccactagggcgcacttccactatccagcgctctcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattaggtagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcagcaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtagggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgctaccggtttaatgtaaggggtattgtatgagcaaacagaacctgtacgacgtatacaagcgcccgaatgggctgctgtaccgggtgccgctgcgcagcccactgcataagcgcgcggagttctatgcaaagcatttgcagcggtggataccatccgggcacaaggttggtgggttaatatctagcgaccgcagcgccatcgtagcccgcaacgtggtgttcaaggacagcgtatgctcacagtagacgaaacagcgctgctgtgctggcgtctgctggaaacgcagggcaagtgcggctgcacttgggagacattcaaagaggttcctaatgaactcaagcaaatcgtgccagttgaacgtcgactactccgagttagaaaagagggggttggcactgtgctcacaacctaccgggagtatacagagtctgccgcgcggcggttgcaagagcacattcagttcgatgtggttgcggctctacggcggtacgggtatcgtggagcttttacgcaatttcgggccgcagtccgggcttattacaagcagcaacaactcgctgcgtggtacgcacgctgacctcgttattactgacgaactcaaagaatctattcaggagcaaatgaaaatgcaggaaactaacacagcacctatcgaatggaaagtagtattaccggaaggtgcaaacgcactgccaatgcgggggtcaatgtattcaagtggtgattactggacccctttcgaggacttgcaaatgcgaggctatgactacccgcacaccgagagcgcactgcaggcgcttatgggtctcctcaaagtcagcgcaaacaccccaggcttagaggtatctataggtggggcactgcatccgaaatatcgtgccatgtacagggctgccggtccgttgcaacgggtggacttgtgccgttcaggaactttctttgaactgcttgccccggcgcgagtcaccattgacaacaagttctgggaacgtcgccgcgacttctatgaggatggcgacgtagtggttgagcgtgtacttgctagcgtagaagcattcaccggttacaaggtgcacaagcaagccctgcagttattcgaacgcattatgcttgcgccagaagagcagcagcgccaattatacactggctacgattacggtagccacatcagagacgtgcacgccgtgggtctgctcatgaagctgcacggtttcgtagtgtctagattcgctgttccgttgggcttcggtttccgcaacggcgagcccatcgtgatgctggggcagccgcggatgcacaaggatttcgctgcggttactgagtaccgctgcgtagagatgcgcgtaggtaagtggctcgccaattactacggcaacggggttgacttccgcgacgccatcgaagacctcaaggctatgaacgtagagcctacaacgtacctgtgcaagaccgagcaggaatggtatgacgcctacgagaatggcccaagtagctgcatgagcgggtactcatttgagcacagccctgtgcgggcgtatgctacaaccagccacgggctaccagataacgggctgcgcctattcatccagtacaccggggagctgttcggggacgacttcgaagtgcaggcacgagcaatcgtaaaacctgaaaccaaagagtacgtccgtgcttacggaaacgctgcggatgcaatcctgcgggggcatgggtacaccagaaacactgaatgtctcgagggggtaatgctggcgcgcataccgcacccaacctacaacggcgcagtgctgatgccatacctagatagcagccagtgcggcgtagatgagtatgaggatgatgcctttgtaatccgtgacgcctacgagtacgaggcgcaggaatcagaagggtacatttacgttggcgcagagtctgcccggtgctgctgctgcggagcgcgcttctccgtcgatgacatgcaggaaaccgcaggtggtgatatggtctgcgacggctgtgtagaagatggggactttgtatacgcagttggccgagaagggctgcataatcgctggagctgtacttggtctgattaccacgacgcctatgtatatgacgcggacattgagcactgttcggtagaaggggtagtgcatgaccaagaagagctggtgtttgcacaggaccggcaggtgcttattgagcacgcagaagaacacccagtgcacgggttaattctcactgagcatgcagctgattgcttgggagagaagtacctgggcaacgatgacgaagaagtagaggaggcagcttaatgttcttgaatccgcacgggattgatatgcagctgctcttgcagatactgcgaacgcaccggcctagctgggcaagcactgagtggtttgagccgctgcttatgcaagcgctgggtagtggtatgcactacgtaaaggacaagcacgggaactacttcgtgctggtgggggactcagagcaaagcgacgtagcgtttacgtcgcacctcgatacggtggcccgtccaaccagcgctgcgccggacgttggttgtactaacaagggcgtactgttcgtaaagaatccgcagcaagctgactgcttgggtgctgactgtggtgccggtatctatctgatgctggagatgctgcggcggggtgtgcacggacgttactgcttcttcgtggatgaagaggtgggctgcgagggtagcgctgcatcggtcaaggatgactctggattttggactggggtcaaggcgatgattagcttcgaccgccgcggcgacggtatcattacgcatcaaaggtatatgcgctgctgctctgacacctttgccaagaccctagcagagcgcctgggacgcacggagcagcacttgcagaagggtgtgtatactgactcagccgagttcgttggcatcattcctgagtgcaccaacgtcggtgtagggtacatgcacgagcacaccccggatgaggtactggacctgaacatacttgggcaagtgcttgagcgggtactgcaagatggtacgttcaagcgcctaccgattgagcgtgacccgaaggtagtggagccggaccagtggctctctgcatctacgctcagtttacggcagccgtgggacctgccaccggacgaggacccgcaattgctggctgcgttccgcgtagtgtcgcagctttctaaacaacaactggttagctgggtgcaggagaatccagagaaggcggcggagtacataatggtgttctccgattacggctttaaagaagagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcatgggaatattattgccaccgctgtaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacaacaaccgaagtgggtaatgtacggccatccggtaccgttcgctgccgcggcacctgccgtagcaccggctgtagctgcggccgcgcctctaaaggtcgtgctcaccgaggactatctatcagcccggaagatacagcacgcagttacgagctacagtgcgttgaacgtgcaggctatagctatgctgggtacacgcttgcccacgccgctgagggcttggctgattcagaatcgcccggaagtggttctgatgctggacaatgacccggctgggcacgctggggtagcggcagcacgccgagcattgcgcccgttcatgcagtgccgggagcattacttcgctgcggacccgaaggacgcagaaattaaagagattctggaggctatacaatgcaaccacatatccagagggagctagttaacaaactaagggacgcggcggtgcgctatcatgggacacaacagcttcgggcagtaatagctagactggtacaagaggcgcttgaaggaggtaagaattggaccttatagttgttcgtgcgatgtgcacgcagaaagtgtggactcgcttgcgagagcagattcctaagtcgatgcttgcgccggacacttcgaaccttctggactgggtggggttgtactggaacacgtacccagagcaccaggaggtgcagtgggatgcgatgcagagcatgctcaacctccgggcggggcacttatcccgggaagagcgggtaatcatggacgagcttatgcggggagtacaagccgtgccgcaggattctgtggtggggattgtccaaaccctgaatgagctggcctacagcggggaggtagcggcgcttacgcagcgctaccaagacggtgaggagattgattacctcctggagatgaagcacctgcagcgcaagtacggtgatggcgctgcggtgcatgattcgctgcttgaatgggagagtggtagtgttgacgagatacttgccgcgactgatgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctgtatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgctcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgatgggaaacacgatgaacttgaaactattctggatgcgctgcgtgaacgagcacccaaaacacatcgaagaacggttgagcacttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgc

SEQ ID NO: 159 - DNA, 43027 bp, Unknown
  source: /note="Description of Unknown: MCoc4c Bacteriophage Sequence"
agtctgccgacgctatcctggatacccgagtaactaatctagagcagacctttatatccgacagggtcactgtaagctacccttggtttacagtactggatacccccacagacaccgtgacgccgcccatcgcttttagtaaggccatagttgagctaaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggtctcagtaggcgaactggcgtacaagggcccggcaaacgctgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacattgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccccactcgtggggaccgtacttcattcgaaggctatgatgtcaactgcgacctgaaaccgctggataaatccgccagcgtagcctgtgtaggtatcactgcatccctgcaggggaagcgcgcggacctgctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcactgattgagaaggagctggacttcggtccggaaggcttccagctgcagtacatgctcgacactacactgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatccaggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgcaatcgctatgatggtggctacgctgaacgggcacctggtggaagatgagaaagtggtggctgagcgtgagtatgagaagatggctcgggccttcattgagaacccgctggattgggcacagagcaaagtgtctaagggccttcggggtgtggctgctaggttgcagaaccgtggcagaggtaaacaacatagaggaagaagataatggcatttgcagaagcaacactggcacagcgccaggcagtacgtaatgcggcagtggcgcttgataaagcaacaaccttggcgcatgataccggcccactagatactctgggtccggatgtagatgcagcaggggctgtagcagtggcggcactctctgctgcaggagcctctgacggtggtgctgtagtggtggttggtaacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcaccggtacaatccaggcagagcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtatcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcaaatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacactgagcctggatggtattacagtagagcgtgctcgttctgttccatttagccttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagatcctacaaagttactctgtttaatcctggggctgcggcaattacccctggggctactcgggctagcttggtgctgcacttctaacgcacagcgtaaagcccaggcccagtctaggcgagcaggtctatacctggacctgaaatttattagactcacgcgagcccctccctcaccctgaacgcgcccaattgcccccatagggggtacctagcgtcaatttagggggggggggggcactgagtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcctgtccagcggggccagtagtggggccatagtgggccagctagtgcgctgtagtgctatccccggtgctatccctagtacgcactaggctatccactggctatcgctagtgctttacattgtgctgattatatgctacgctgcgcgctccccactagggcgcacttccactatccagcgctctcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattcactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgctggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggcaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactctatggttaatgtattcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggtagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgtaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaagacctcaaggctatgaacgtagaccctacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctacaacggcgcagtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgccgaagatggggactttgtatatgtagttggccgagaagggctgcataatcgctggagctgcacttggtctgattaccacgacgcctatgtatatgacgcggacattgagcactgttcggtagagggggtagtgcatgaccaagaagaactggtgtatgcacaggaccgacaggtgcttattgagcacgcagaagaacaccctgtgcacgggttgattctcactgagtatgcagccgattgcttgggggagaagtatctgggcaacgacgatgaagaaatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggcgcgcccaaccagcgctgcaccggacgtcggctgcactaacaagggcgtgctgttcgtaaagaatccgcaacaagctgactgcttgggggcggactgcggtgctggtatctacctgatgctggagatgctgcggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgccctcagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctaatcacaaagggaatcatgcctgaaatggtgggggatgcagaatggagcaaagagaaacagcggataatcttccgtgtcggaagggctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacgtccatgactgtattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggcggtcttaaactgggcgtgttcgagcaacttgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcattggactctggcggagattaaggaccggcacagtaagcaagagttcgtgccagcctacctcaagaaagtaggcagggctgaccggattcgtgttaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtacgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttggaccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgctcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcaccgcaagcacctgcagccccagctgctccagtggctcctgcggctcctgtagcgcccgctgcgcctgctgcacctcaagcctaatctaccctaacctaaactaatatggccccgcatggggccttagaggaagactatgaacatcatcaacattctcatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgctaacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgccgtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctgcgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctatccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgcagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgaacagtttgtgagcctatacgaagagcatgacctgcttggggatattactcgcgcggcagcagcagctggggcggacttgacggatttggatatgccagaagtaggttccctggacatccggcaagtgctggaatcgcctttcttcttctgctgataaatgaagttaccggagtaggaatgaagttaaaacacactagtaaaacttccgattacactctcaaggttctgtataagtctgacgacattacagacgcagtgaagcaactgcacgaactgggccacggcattagtcggggcctggctccagagcagcactactggagagtgctgggaagtatattgggtaaacagtatatactaggagtctatgactcccaaggcggattagtcggtgctgtcagctactatccagaagctgtggaggactgtcattacgtagagcctgtgctgtatacagacttcttcgtactaaaaccggacaatggtgcggcagtgactgtgattatgcaggggatgcacgcgatagccaagtgcatgcgcgccgggcgtattgccattagccggagcacatcggataacacgtacaagacaacttatcatttagtgaggtcagaatgagtggtggtttaggtaaactgttaggtaaggccacggatatgctcggccttactgacaacgcaggattagaggcacagcagcgcttggcagagcagcaggccagcgcagctaaacaacaggctgccttagaggctaatagcgccgcagataacattgctgagattgacccagcaggggctgcctctgcatctgcagatgcaattacgtctgagcagaagaaacggcgacaagcagggcagagcaatcctctgggcctgtaagggggtagcttggaacaaaaagcaacattagcagagctctttaagaaggaccaggacgcgggtgtcttggatgcctctgagaagtttgcgcagtggacgctcggcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgccgcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacaggggcatagatggataacgtagaaaacggtcagaacgtagaaactacacaggtagagaaccaaggcggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcacaccggttcgtaacgataagatgattatcgtggtggatacggtgctgtatatccgtaacccgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacataggcctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgcggaagagtaatacgcgcccctggtgccttcgggtgccaggggctttttttttgtccctgtcttaaaggtccaaggggtctttaatagaggaacaaatatgagagaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgcggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgccaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacgggatattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttctatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcatacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgtgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggtagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagagttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtcttcggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggcgtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattataagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcagtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggcccagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccgagaaccgaatccacaggaaaaggattctgctaagggcgcaacaattaaacctgcgcctgagcgcgtagattggaatgatgctggagataacggcctgaacgcgctggagcgtgcctccttactggcgcaggccaagaccccagctactacagccgcagagagctttgcatcgggtatgggtaacagcatcatcgctgcggctatacgtaaggcctctgctccggcatttgaccgagacctgaactttaatgccaagcagaccctgagtagcgacacccgagctaagctgtacgccccaaatcaggaagagattgagtacctacacgactcggtgtcggtcgaagattataactaccgcatgcagcagatgcttgagcagcgtgaccgtgaccgcttaatggctgacaacacagtggctgggttcgcgggtatgttggtaggcgactccccgttcatactggccccgatgcctgccgccggtattgctggccgcgcgggcttagctgcacgtaccgccatacgcgctgctgatgtaggtactgcattctatgcacaggaccaactgggccagtccgccgcggtaactgcactgatagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatcctagtatcgagaaacaataccgcctccgtgaacatgaaagcacagcacgtagttcagttcttgaagaagtctgaacacttgacagcaggccagaaggctattctggacacgctgggtgatgctgtaaacgacattgattttaaactggtagcaggctccgcaaaccgcagccgctacacttacgcacaacaagatttagctaggcgcggggaggtatctctacgcgcacctaagcgagctaatggcagcacctggactacagccggggacgcactgcgcgctatggatgcagacaccagcaaggtagccgtgcacgaactgattcatgccgccactgcacgcgccgttgacagtaatcccgagattgctaagcgcctggaggaagtgcgcgctgttattgcagcagactccaccttgacgccgcgtatgcggtattacgcaagcaatgtgcacgagatgctggcaggcttaggcgacagccctgagtgggttgagcatctggcgcggacgaaatccccaaccggtaagagcatgctccgccaactgggtgagtacatcatgaacgccctgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccggatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcagaggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcgaatccggtagcacatcccctgcgcggaatctgcgtcagcgtactcggttcaacatggacaaagagtatctggtgaacggtaagagcatgcgcatgcaggacctgatggatactgatgtagccaaggttatgcacgggtacactaaccgtatgtctgggcgtgtaggcatggcctatgcaggcgtacaggacctgggacagctcgctaagatgattgatgagtctaagcacgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcaagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaacgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacgggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacagtggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaa

SEQ ID NO: 160 - DNA, 43649 bp, Unknown
  source: /note="Description of Unknown: MCoc5c Bacteriophage Sequence"
gataaccccggtcagtttcaaggttataaagataagacccagtacagaacagattcccattttcattggtacccctaattaggttttgattatgtcgccaacttttaaactcagagctgaggattcatctttataccaccgctctgtctcagatttgtgcccccagcagtcatactccagggttacacgatacacctggtattgctcatcccatacgggcgcacccactcgggtgacggttgcgtctagcaaattcatttgcttctccctacccatttcccggaatcgtcaagtaacatggggatgatttgcgggcatccatctgtaatcaccatacaccctagaatcggcttgcttcttgacaacttaccataagcaaaggccagactcttgttgtcgattaaacaaccgcagtgcgcaccaaagtacagggcagtgctgctagcggcatactgtatatctaacttcccatggaagtgtccaatcaccatggacttacgttcatgggctgcgttgagcagcaggtccccagatacttgatgttggaatcgcacaatacccagtggagtattcaaatcccaagcatcgccccaactccacccgggggccccatgctctgggaacaggatgtcccggtacttcttaatgaactgtacagggagtccatgagctttggctctgcggtagacaagagagccgtggttagagtcgcacaggagcaggttaggaaacaggttatgcagccgctccaggccaagcttggccttctctaactccaccccagcactatccaactccggactgctgtcgtgaaagctaatggcgtgcccatccgtctcatcgcctatctgcacaacaatgtctgggcagtactcgtcccgtacagtgcgcaaaaagtcgtacgcgtccggatgtgtgtacggctcgtgcaggtccccgataacgagaatacgtcgacaggtttccggtacaaacgtatccccaatgtcatccgttggggagggctggattagtttgcgggcttgcatcaaagcattattagcctttgccttgctgcccttgttatccatgaagatgctgcgccaatagcgcacaagctgacgagatacactaatgtccgtgtccacatccccgcgattatccagctcttggttgtagtactgagcagccagagcgttgtctaggtactggcccaggattgcctggtgctgctctttggtgaatagttttattaggctaacacgtgccattattgcctctcttgtgttgttcctactcgtatcacattaattctaggggaatcacagaatcaagccaaagtcaacaaataattttatttaattatttagttgaccctagcatatttccatgctaccctaaccccctacaccacccaagggtacacctatcactactcttcgataagcttgtactccccggggaagaaggtgacgccgtccccgggcctacttactaacagtccagggtaacttagttctatctcaccagtaaccgggtcgaagaatataaccgtgtgccttgtacctggggtgaagtatgctgcatacctcgggtctatcggctcaggcccaagatccatcaactccacaacactgcctgactttatactcattctaccttctccttactgtacatactcgtacccatctcagcctctgctgggaacgggacctcaccaatgataccgtagttaggccagagctggtggatacgcttaggtgcgtcctccatgcactgcttaaccagcaagctcgcctcacgtccaacctctgggttggcgctgtccaggtacagcgcatcgtgcacgttcgtaatcaggcacacctgattgtcgaaccagtcacgggccaagagtgcacgcagaaccataccggccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtacatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggtaatccttcacggaaagctaggcggtaacagtgcatatccgtacctgcctgtagcaggcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacggtggcacaggtattcaggcggtggtgtatgattccggaaccatcaggacgttcagggattacgtactgcagcattcccttccgctctttgacttctccgtttgcatccagaacttcccgcaaatagtaagtaccagtgtccttctcaagcgccgccagctcgtttaccaacttacagaactcgaacccttggcgagccagtgcctccattgcgtcagtgctggtgctgtatactggcgtgccgtcatgcagggtacgcgcctgccggaactctccgcgctctgcgtacttctcccggataacttccggaagctcctggatgtccactaggcccggacagaagtaaaggtcatcctcccacttaagtttctcctcctctgtatcaaggcggaatacttttggcagccccttgttcttaccggacttgtacgtggttgcaccgggtggcgcgggcatgtcgtccacggcaacccaagtgtccccgacttgccaatagtctgccttgacatactgcggggggaaatatggaaccttcttgcggtacttgataggtccgccgtacaccagtgcagacatatggaagtccgaaccgaagttgaaatccagcgtctccggcaagtccttcgggatgtactgctgcagctcctgcttaatctccaggatgcgctgctcctgctcttcttggttcttgcgagcaatcggcatattcacgaacaggccgaaccattcgcagtacgcccaagccagcaaggcatccatgcgctcccacacgtactgcatctgattgcgctgggcgaacgtagcgcactggccgtagaagcacagggccgtgttcgggatgtccccgttaaccaggtagtcgtgcagtagcatcgggtcaatctgggaggttagcacaccctgctcccacagaagcttaaccccgtctactttgtgcgtaccaccgtacttaggagccgtctcgtccagcgacggatacatgctctgaaagtccgaggcgatgtattcagaatgcatcgtacagaatacgcgacctccccgctttaggaaggcctcaaactcggcgcgcgcaaaggttaggaaccagctaatctcatatgcggcgttgtgagccacaatcagccaacagtcagctggtattgggagccattctgatacaggtgccgcttcaaagtgcgcgcgactgttataccgtacactctctacggggcctacttctaccgtaccgtcatcgtgcgtgcggtcaatacgccacgctgattctacgatgtaattatccggacagtacggggaagcaacactaccgtaatatgggtggttttgcgtctcataatccgttatcaggatgcttctgctcattccataccctcccctttatgatattagatatgtatccttgacttgtcccgaagcgtctcgctatagatatctgggtctcaccgccagcgtatgcttctcgtatgctgtgcacgtcttctggggtaagtctggcagcagggttgcggctgcccagcaaattacgcgcacctttatttcggtcctgcatattatcgctaggagtccctagtagcaggtgctccggatttatgcaccgaggattgtcgcacgaatgccggactacaagtcccgcgatatcgctcagcttcaagttgtgggctatacagtatgctttgcggtggctgccagttgtcttcccgtcaaatctggagcggccatacccagcgccctttcctcggcaagtgcttcccctctgtccgtggtcaatacaacctgtcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcggtgtcgcaccacgtaactaccgcgtataagtcctgtgtaatccactttttggataacccctgtatagtctacttgcataaatcctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcatcagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcatcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagcggcgggaacagcatgttgtaaccttcgagtgaaagctgcatagtgcctacaatagcgcagtcgttctcgcacccaaggatacgcagctcctgccatttcgcctcaaggttctggtgctcactctccatagtgccgccacggatattcgccaccatgtcgatgatgattaccgcggggcgcatctcctccatgagcgtggatatctgcgccatcgtcaatgagtgcgcagccttaacacgaatccggtcagccctgcctactttcttgaggtaggctggcacgaactcttgcttactgtgccggtccttaatctccgccagagtccaatgcagcgccgcttgatatacccgcggcactgtgcgcgtcgccggaccctcgttaacaagccagaggatagggcggtccccgtacacttccggctgctgctgcatttgctcagcaaaatccacagcaatagcagcaagcagactagttttaccagagtccacaggagcagccactgcgatacagtccccgccacgtagacctcggatgttgctagcgagttgctcgaacacgcccagtttaagaccgccgctctcgtcagtcgcggcaagtatttcgtcaacactaccgctctcccattcaagcagcgaatcatgaacagcagcaccgtccccgtacttgcgctggaggtgcttcatttccagcaggtaatcaacttcctccccatcctgatagcgttgcgtcagcgcggctacctccccgctgtaggccagctcgttcagggtctggacaatccccaccacagaatcctgcggtacggcctgtactccccgcataagctcgtccatgattaccctctcttcccgggataagtgaccggcccggaggttgagcatgctctgcatcgcatcccactgcacttcctggtgctccgggtacgtgttccagtacaaccccacccagtctagtaggttcgacgtatccggcgcgagcatggacttgggtatctgttcacgcagtcggttccacaccttctgcgtgcacattgcacgaacaactattaggtccaattagagcctccaagttttagctttcaatacatcgtgcactgctgacacacttacaccaaggctagcagctatggccggtgtgccgtgttccctgctgtaccgcctgtaggtcttcctgatatagtccacctgctgcgctgttagcttggagtacccattctgctcccctttagaaactccacgtctagccctaccccgggcaatacagtcatggacgttatccttgaccgtacctaattctaaatgctcgggattaatacatctcgggttgtcacacttatggcgcacaactagccccgctatgctctccggagatatatcgttcgccgagcaatacacctttctatgcaggggtatcttccgccctttgaacgtggtatttccgtaaccctttggtccgcctttctgtttgtgctctttacacgcgcctaataccatctaataactcctgtattgttgcctcttttgggtccccgtcgtagtagatttcgtggcacgacataaagggacgtagcgcgcgccgtatcatggccgcgccggagtgtcccgcttggtcattatccagggacagtatcactgtcggtttgttctgtatcagccacgcccttaactgcacgggcaagcgagtacccagcatagctatagcctgcacgttcattgcagagtagttcgtaatcgcgtgctgatatttgatcgctgatagatagtcctcggtgagcacgacctttagaggtgcggccgcagctacatccggtgctacggcaggtgccgcggcagcgaatggtattggttggccgtacattacccacttcggttgctgtcgagcatgaactgcacgacccagagcagcccttccgacacggaagattatccgctgtttctctttgctccattctgcatcccccaccatttcaggcatgattccctttgtgattaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacctgcttgcagcggtggcaatagtattcccaggcatccgggttattgtagagcaccccggcggcgtccctgccgcagcaccgaaagcgagccctctgccctacggccaggcgcttgcacgctctaagccagggctggtccattacttaatttccagggtagtggcgtaagtcaagtcgggttgcctaagaatctggtgctcgttcaacagcaccggtgccccgtcatgcaggtagaacatatccccaccaggagattttatggcccagtaaatctttgcaccccaggtaaatggaactgccgttctgggggcatcaggcaaggtactatagtttatggtactaggcatttgctttctccttccgtttgatttccatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccgccttgtccgggactggcggcagctcatccttcgggtcttgatacagctcgaagttatcggcgtaccacgggtaggggtcggctcctccatctgtaaagttatccaactgcagccagtggccgcttgtagctatatctgtaattacgtagtaagcaaaatcccctaggtacgacttgagcgacgaattgtttttgtgtgctttgcgaacaactttatcaccaactttaaacttagacataatcaaccctccacaatattatcgtatccgccccagtcttctacgactcgggtgcctagttcaatcagttcttctttaaagccgtaatcggagaacaccattatgtactccgtcgccttctctggattctcctgcacccagctaatcagttgctgcttagaaagttgtgatacctctcggaacgctgccagtaactgcgggtcctcagcaggcggcatgtcccacggctgccgtaaactgagcgttggtgcagagagccattggtctggttctactaccctaggatcccgctcaatcggaaggtgcgagaacgtgccatcttgtagtacacgctcaagcacttgccccaggatgttcaggtccagtacctcatccggggtgtgctcgtgcatgtaccctacacctacgttggtgcactcagggatgatgccaacgaactcggctgagtcagtgtacacccccttctgtaagtgctgctccgtgcgtcccaggcgctctgctagggtcttggcaaaggtgtcagagcagcagcgcatatacctttgatgcgtaatgataccgtcgccgcggcggtcgaagctgatcatagccttgaccccagtccaaaatccagagtcatccttaaccgatgcagcgctaccctcgcagccaacctcttcgtccacgaagaagcagtagcgtccgtgcacaccccgccgcagcatctccagcatcaggtagataccagcaccgcagtccgcccccaagcagtcagcttgttgcggattctttacgaacagcacgcccttgttagtgcagccgacgtccggtgcagcgctggttgggcgcgccactgtgtcgaggtgcgacgtaaacgctacgtcactttgttcggagtccccgaccagcacgaagtagttcccgtgcttgtcctttacgtagtgcataccactacccagcgcctgcataagcagcggctcaaaccacttagtgctgccccagctaggccggtgcgtttgcagtatctgcaagagcagctgcatatcaatcccatgcggattcaagaacattaagctgcctcctctatttcttcatcgtcgttgcccagatacttctcccccaagcaatcggctgcatactcagtgagaatcaacccgtgcacagggtgttcttctgcgtgctcaataagcacctgtcggtcctgtgcatacaccagttcttcttggtcatgcactaccccctctaccgaacagtgctcaatgtctccgtcgtatacataagcgtcgtggtaatcagaccaagtgcaactccatcgattatacagaccctcgcgcccaactacgtatacaaactccccctcttcgaggcagccgtcgcagaccatttcataatcggcggtttcgtgcatatcatcaacggagtagcgccccccgcagcagcagcaccgagcagattctgtgccgacgtagatgtacccttctgattcttgcgcctcgtactcgtagtcgtcacgtattacaaaggcgtcactgccttcttcgtctacgccacgctggctgctatcgagatatggcatcagcactgcgccgttgtaggttgggtgcggtatgcgtgccagcattaccccctcgagacattcagtgtttctggtgtacccatgcccccgcaggattgcatccgcagcgttgccgtaagcacggacgtactctttggtttcaggttttacgattgctcgtgccagcacttcgaagtcgtccccgaaaagctccccggtatactggatgaataggcgcaacccgttatccggcaacccgtggctggtggtggcgtacgtccgcacagggctatgcttaaatgagtacccgctcatgcagctacccgggccattctcgtaggcgtcgtaccattcctgctcggtcttgcacaggtacgttgtagggtctacgttcatagccttgaggtcttcgacagcatcgcggaagtctaccccgtttccgtagtagttagcgagccacttaccgacgcgcatctctacgcaacggtactcattaactgcggcgaagtccttatgcatccgcggctgccccagcatcacgatgggctcaccgttgcggaaaccaaagcccaaaggcacggcgaatctagacactacgaagccgtgcaacttcatgagcagcgcagcggcgttgccatcgcggaggtggcgtccgtaatcgtagccagtgtactcctggcgctgccgctcttctggtgcaagcataatgcgctcgaataactgcacggcctgcttgtgcaccttgtaaccggtgaactcttctacactagcaactacgcgctcaaccactacatcatcgccctcatagaagtcgcggcggcgttcccagaacttgctgtcgatggtgattcgcgccggggaaaagagttcgtagaaagttccagaccggtacaggtctaccttttgcaacgggccgcgagtcatcattacttcgcggtactcagggtgcagtatcccgcctatagtcacctctaagccaggggtgtaagcgctgacagtgcggagacccataagcgcctgcagcggaccctcattgtgagggtggtcagaaccttgcatttgcaagtcctggaacggggtccagtaatcaccgctggaatacatcgaacatttcattggcagtgcgtttgcaccttccggcaacactactttccattcgataggtgctgtgccagtttctttgatagtctcttgcattttcatttgctcccgagttaattgtattgcgtcgtgtattaatagctcagcgtgcataccacgcagcgagttgtcgttgcttataatatgagcgcacagccgccctaaatcttgtataggctccacgatacccgtaccgtagtagtgctgcgaccacatcaaactcaatgtgctcttgcaactgccgcgcggcagattctgtatactcgcggtacgtggggagcaccaccgcagagtcctgcttacgaactcggaggagtctacgctcgactggtacgattttcttgagctcattaggaacctctttgaatgtttcccacggacacccgcacttgccttgtgtctccagcaagcgccagataaacgccgcggtttcgtctacagttagcataggcttctcttagtcacgcagtttcgtgccaccaacacaaaagccggagaggtgataacgtcacctgctcggtaactgctccgcattaatcccgcagaggttaaaagtatgcggcgctcattaattgccccttctaaagggatgagataatacagaccgctataggtctcccggtacacgtcatacttcatactacaccccgcacattaaaccggtaacagtagccgcgcagggtcatacccagtcgctttgcttgtttctcatagtgctgtcgcagtcccgcctttgcgctgtactcccgcgccagcccgtcgattgttggttgctgcttacgcatcagcagcgtttcaggattctttccgtaagccttcatgccgtacccccactgacacggcgcacgcacatgagcttagtgtaaggcccaaaactatcatagcggcgctctgcatacacagctactacgtcatcggaaaccttgacctcttcgcccaagtatcttgcaggcaaggacttgtactttccagtgcaatatgggtacttgatagcgccgggatttgcatccgcaatacgcaacgcctcagatttacgaatgaactttaagactttcatagccgccaacacctctcaaatttcgttgttgctcttaccatccacagtgagcgtcaccgcggcgtccgggtactgctcctgcaccgccgcaaggatacgcgcacccagctctttgcagccgccctccgggtattcgaataggtcgtactcagggcgtggctgcagttgctgtgttgctggctgctgcaattgcacagtacagtagggcaccgggttgcttgcgtcatttcccagcaccagcatagcgctggtcacaatgatgttgaatacattaaccatagagttgtctccagtcgttgataatgccaagattcacggcgtccagcacagtgcgggcagccatttcggtgtagttatccacaaattctaaaggggattcctgattagtgtctttgtcagagaatataaccacagtgtagctgtattcttcgtatatccgattgcaccacacgggccagagttcatggcccggatagaccagtattgctttcatatgaaacctcatacgccagttgcattcacatagcgccccgtaggacgctataggcttgctactaggccactgccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggccctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattactccacatagcaccccataggatgctataggctgtaattagtgcccaaattgggagttaacagcaggccacccactaggctgtttactgccgcccttttgtttttgctttcccctcaccctgtgctcaccgctcaaccattgtttgctgggctccacagtaagcggcacgttatcggtagggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcaaatcagcttactgcttgctatctaagttactcagttaatcggaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactttgggattcaatctagcttatgttcttcgcggtgtcaactctttttatcgagtgtctaacccttcacactatctagccttaatccggcggagcctcccggctcggctccgttcagcacctcagcgcctcccggtgattgaactatagccccattgaaccaaaagaagcaagtaatattttcaactttttatcactaagagcaaaaagggtaagcagggcaaatacttagagctgcacttagaaccacactagggatagctctaggggtactctaaccactactaaccatactgcatagtactgcatagagcgtagcgtagtgacgtaaggaacgtagtgtagcgtagttaatgcttccctccctacggtcggtcatacagggcattactagtgagtactagtgagtagtagtgtatatagtgccctaaacccctcctactccggttacttcatttcataatagctttcgaatgaaagtaagagcaaagggatagcgctgggatagtggatgtgcgccctagtggggagcgcgcagcgtagcacagaatccgcgcaatgtaaagcactaaggatagccagtggatagcctagtgcatactagggatagcactagggacagcactacagcgcactagctggcccactatggccccactactggccccgctggacaggcacaaaataagcaaggcagagcacgcccctatggcccacagggagcgcacagggatagccctagcgcctcatagcacgcactgagagcgcacaggaagcgccctagtgaacgcacaaggacaggcatagggtagcactagcgatagccctagaacgcagcacaggcccgctgaggccctctggtgcgcactagcaggcccacccagtgcccccccccccctaaattgacgctaggtaccccctatgggggcaattgggcgcgttcagggtgagggaggggctcgcgtgagtctaataaatttcaggtccaggtatagacctgctcgcctagactgggcctgggctttacgctgtgcgttagaagtgcagcaccaagctagcccgagtagccccaggggtaattgccgcagccccaggattaaacagagtaactttgtaggagctgtacccactgtagctactgacaccagttagcagcccatcaacagacccgttaaataccggagaactcaaaccgacaggggcttgagtaatgccgtacgggagagtctgtacagggctagataccagcgtaccggcagcgacagcaccaggggtccacgcaaggctaaatggaacagaacgagcacgctctactgtaataccatccaggctcagtgtgtttccagtgctgttggtgaagcgcaaatctccgtcacccgttaggctgttacccaagtaaaagtctacatcgaaccaccctggaccagccggtaccgcggcaacagaggagccgccactacccaccgctaaggttatgttaccagtagcgcccgggttgtagactcgcaaggatacgcgcactatagccccgagaaggtgcagcggcaactggtaccgacgcatctcctgacccgcgggaacatccagtgctacagtactagcggctccagccctagcggtacgactagcagcagcagcgccacgcatgtacgcctgcccgataaacccagggccgaacggactatccccgcgcactacgttcatgttcccactgtacacgcgcggagggttgatgcggcaagccctagtactactcagtgaccaggatagaacactgctggcatctgcaatgttcgcatcattgtcgaaggcatctacataaccaccttcaatggtccagaattccccttcgcatccatacgccttgttatcagaaataacaatagggccaacagctccagacctaatacgaatacacccggcatacaggttatggtcggagtccgggcggaagtgcgcaaaaccattacgggtaatccaagagcgcgacagctgtccaaagtccagtacgtgctgtgcagctgtgttagccccgtatggtacactatcccactcaaacttattatccgtaatccacaccaggtccgggttactgtttgctgtactcttaatccatgcgcccgagcacagtccgaacgtgttattctgaatgtgcaggttattgacgttgttattaggaatacctatgtaatccccgaggagtataacgctgccgttagaggcacccatcctacggaataagtttccggagatgtggctctccatacagtcacgtaacaccagcgcagagcccgccaagttattaaaagcagagttttccgccccaaaatagctccaggatgttacctccaccataagtcccgaatcactgctgacagccccctgcagtcgcattctaaggaacccgccgcccattccacgggtgctcgtaccgtcaaagtagaacatcttgctggctgtgctcggtttaacgaatacagccccaagcgggttaacaccctctaggccatcacctataaacagcatagggttagtaaggtggcagtctccaacataataagaccccacaggtactcgcagcacctttacacctttagcggaaatccgctcaatagcggctgcatagttaccggaagaatccggacggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacgttcttgtactggttcccgatggctttgctctgccactgcctgcgctcccataggccccagcacactttattgcgctgcccattaatatactgggagcagtcgaaggtccagcggttgctgcccttgtacacccaaccggtgccaggggacttctgctggtacttgctaatatagcgccagtccagtacagcctttccagccgctgcgtaatccaggctcttgagatgccgcttcacagcactgccgttgaagccagctacgcctacgttgtaaatgaagtccacagaccccaccagagatacgtcagagagctgcataggaagcccgtcaagggcctttgcgtgttcccctgctgactgtatcagttgcttctgacaatcgctcagcgtggctctctgacccatcttgacgccctttgtctccccatagcagatagtagggaccccggcgctatccttgtaggcggtaaggctcaggccctcgttgtgctgaaccaccccggtaatggcaccgccaagcatagtggcccccgtaagggccgcaataaccttagtccttaaactcatatttaatagtccccttacgtgcctgctcctctaggagcttgaatgtacgtctcttgtaatacgcattccacgccagggttagcaccgcgcacaccgtcgcagtgatgaagctgatagtgctccagttccagctcattaactctgccaaccaacctcctgataccgtagcgccggtaactgccgcacctgcccgggtagcgaggtctgccccaactacgtcccctaccttaatcatcctgctgctccttcttcctgaacagcttacgaatcaccagaatgaccactaggaagaccagaggaatgctggccccagctaatccggcgaggataagactgtaactatcattgttaaccacctgcaggcgctctgcctggattgtaccggtgctaatagtttgcacctgctccttactggacgtgtccaaagtgcctacgttagaatctgatacatcggttttgttggtggtgctggagtccaccttgttattcaagccaacggtttgcttggtgttttcggcaccaacctgagcagatacatccggcttagaaccaactaagccggtgagtgcagaggtcgccgagcaaccagtcagagtaaccgcgagcagtaacccagcgaccagtttacgcattagctagcagccttcactgcggctaccgcggcttctagcgcagcaatcttggtatcgaaggtagcacccgtctgggccacgtcctgcggctgcgtaagcatagcatacaggtccttaccgagaatgttcagctggcgcagcagctcctgctgttgcgctggggttgcttttgcaattgccatagtattgctccttactcaacagagattgctgtgattacaccatcttctacagtgatagttgctgctacagtagcggtagcccccgcctcccgagcggtggtgaacgtaataggtgcagttacttctgcgccgttaccaaccaccactacagcaccaccgtcagaggctcctgcagcagagagtgccgccactgctacagcccctgctgcatctacatccggacccagagtatctagtgggccggtatcatgcgccaaggttgttgctttatcaagcgccactgccgcattacgtactgcctggcgctgtgccagtgttgcttctgcaaatgccattatcttcttcctctatgttgtttacctctgccacggttctgcaacctagcagccacaccccgaaggcccttagacactttgctctgtgcccaatccagcgggttctcaatgaaggcccgagccatcttctcagactcacgctcagccaccactttctcatcttccaccaggtgcccgttcagcgtagccaccatcatagcgattgcgtctgctcggtcgtccttagctaggctaccgcggtcgtacgtgatgccggacaactgcgcgaacgcggagtacagccaacgtctatcgcgggagtatgccatacaggtactaatgtcgtcgtggatagcacgctcgtgcactaccaggcggtgccgacgagtaactgggctgattgtgtcaatgatacgacgctctttctgcgtggagttattcaggccccttacgccaataccggcgagacgccgctcccgcagacggttcaggataagcatagacacggtaccgtgccccatgttgctctccacaaccatatcctggatatctaactctacgcataggtcaatcagtttatcaatgttctcttcgctgatacctccttggaagccgcctacggagaataggtggatgtacgagttcgcagcaccaccagcagcgtaagacacttcgtccccgccacacccagccgggtccaccaccagcaccttatgctggtacggcaggtgcatgtccccgtagaatgccgggaagtacatctgctggcccataatcccctcatgctcatgctggtacaggtaccggcggtccgcgatgtaggagaacgtctcaggggaggaatcctggctaccagagtaaaccagcatatccgaaagcttgatgcgcgtacgcatttggtcggacagtgtagtgtcgagcatgtactgcagctggaagccttccggaccgaagtccagctccttctcaatcagtgcatcctcgtcatagcgtccggtgtccgtgctctcgcctagcgtcccgtcgacgccgaagccggtgcgtttatagccgcgctcaataagctccaggatataaggagcaagtgtacttccatatcgctcttccatttcaacagacggaatgcgcccgggccacacgcggacctcgaagccgcgtcccggcagggttttatagatactgtccttggtctgcggtgtgcccaggtacagcgtatccccgtgcgtacagatagctgcgaagtctttagaaatcatcagcagctgctcacgctgggtttgcgttaaaccgttcttagtggtctcgatatcatccggaatcagcaggtccgcgcgcttcccctgcagggatgcagtgatacctacacaggctacgctggcggatttatccagcggtttcaggtcgcagttgacatcatagccttcgaatgaagtacggtccccacgagtagggtcggcctttaagtagcacagtagaggccaggtttctagcatacgaatgattaagttcgctacgtcagaggcctgcttctctgcaccggacacaatcaggatacgacaggattggtcctggatgagcctccagacggcgtacagtgcagctagtgtagacttagcctcaccacgctgtgcggccaccatgcgcttcctagggcccttctgcatgtactctgcaatgtcggcctgcatgtccgtcaatgtaaaacccaggaaccgcatacctatgtatgcgaattcccggaagtcacttagcgccgcggccatcatcatcgcgatgtcctcgcgctcctctttgggaatactgcgcggattcgcactataaccagtaagtttctggttgagcatgcgcagtcttcgcgcagtcttcaccgataccattagacaattccttctagtaagtcctcagagtctgaaccaccaactttatttagaatttcttgcttacgcgcctctctacgcgccgctagttcatcatcgaactcgtcacgaaggtcctgcatctcctcggaatctgcatccgcggtgatgtcgttgtccttcaagaacttggcgataaccgatttatctgcggcggggagcggcacctcgtcttccttagactgcttgatttcttcaatcaaggcctcagtgaacatgcggtgcagctccgagaggcgactgcgtttagccgcccctgccattgtgcctccagtaattatttaagttttgataatcccagcacttctcagctccgctaacagggcgtttagctgggtggcaacgttgctggtgtcggtactatccgccacagcgtttgccgggcccttgtacgccagttcgcctactgaggccagccagttgtcaaaagctgcctgggttacatacccatcgcccgcctctacatctgcgcccagcctagccgccacgagcgtaccggccggtagcgtctccgcaaacagcaacgaatttcccactaccacaaagctgtagccggggatttggccctgcccattcagctcaactatggccttactaaaagcgatgggcggcgtcacggtgtctgtgggggtatccagtactgtaaaccaagggtagcttacagtgaccctgtcggatataaaggtctgctctagattagttactcgggtatccaggatagcgtcggcagactttctagcagcctcttccgcatccaccctttggtccagacgggcgtcgccggaatcgacgtaacccttgttagtggcgtccgcagtgtccactgggtctcctaggtgggtgattcgatatccgtgcatactgatatcgccgtagaagccctcaatagaacgcccctcaactagctcttgagccaggtgcaggaactgcgtattctgggtatctacgttgccttcaataaacggagcaccgctagagaattcaatgtaaagatactctcgttcagtcttacgaattaggagcaccactgtctctgcagacagtggcgagttcagacgaatattggtggagctggtccaagtgaaggcagtagtctcagcaccatctaagtaaacgtgaatataggacttatccaggtactcgatatcgcactggatatcctgagtacctgcaggctttaccgactcttgccagctgaacgccatattaatcgtctccgaagttattgatgatagctcgcgtaggtgcgaattcctggattagcggtacctgcttagtgaaggtcttgatatccatattaccggtagccaggtcctgtacggccccgagcagccctgtgacgtaacccatagatgccaacgagtgacgaggagaatctcccaggaaaatatcctgcagtaaggataccccgccgatggcactcatacccgttacggattcactgatgagtttctgggtgtctacatcctttccgtccatgccatgcttggccatagtagccagcagcatcaacgggaactggtacgccataatgtgggccacaccaatccacccagcatcgttcagctctctacgcagaatcttgttagtggcagccagtgcgaagctctggtaccctacaatgactttgccgataggattgaactgcgcaaagtgcgaggtctcgccggtacgaatctgctgtaccaggtagtccatcatacgcgtccctacaacctcaacttgcatctgcaggtccggctggaacatggcgcccgggttagccttgttggcagcgatagcgcggtccgcaacgtcacgggtaagcccgaaacgctccagacgcttaaacgcctcagcatcgcccttgaacatctgcgtaagctcatccgccacaatgccggagttcaggttaacctgcagccggtgcaccatactcattccgttgacgtgacgtgcagcctgcccaacgttctgagtgacgttgaaccaggaggcctgacgggtcaggtccaggttatcgtcggcgtacgtattcaaccagcggaagcgcatctccttctggatattaccacgcagcacagtgtctagacgggcagccatatccggagtcttgatagctacggcaccttccttgaaccaaggctggtcacgcatactgcgcagcactctagccataccgaactccttcatggccaaagcagtatcagtcagctgatataggccggagttcttaagcatggtggcgttagccatgttcccggctgcacgcagcaaatccggaagctgtccagcgtcagcaggtgccccacccaggataaagtcgatggtgtcattgacggtcttctcccacttagcggaatccgctagcgcgtgcttagactcatcaatcatcttagcgagctgtcccaggtcctgtacgcctgcataggccatgcctacacgcccagacatacggttagtgtacccgtgcataaccttggctacatcagtatccatcaggtcctgcatgcgcatgctcttaccgttcaccagatactctttgtccatgttgaaccgagtacgctgacgcagattccgcgcaggggatgtgctaccggattcgcgtacgttaccagccaggaaactctggattgcagactcatctacaccagcgctacgcatagccataacgacctcgtcgttacccataccgttaatcagctgcttccacatagggccagactgcccggcgcggccattatagataccgtcaaccatctccttggcaacacgctgcactacctctgactccatgctcgggtacacgtcccgcagggcggaccggaacagggcgcggtagtcgtccagagtgttaccctgtgcgataccttgacgcatcttgtcatagctgtactgacgcgggaagtagtagtcggatttaaccaacgcaccatcatccactagacctgcattgagcatatgctcgtgccacttgctagcccagccagagcggcgataggcgtcaaccagtggagcaatctctgcatccggcaccggcacagcgcggccatttacatcagcactgtaggcagcatccaggtacttgctcaggcggtcttccagtgcagcccgctcagcgcggaacttgctccgatggaagaagcgctcagagaaacctacacccttatccttcaacgcacccaggatagcgtcttccactacgctggcgctggcgtccatctccaaagtaaggttgcgtttgaagtccactacggacgggcgacgaccccctacggcggacgcatccgacactagcagcttagccaagtcttcgttgccttgggcgatgttatcgtacagggcaaacatagtggagagcttcttcttagcgccgtccagcatagcttgggcacccttagcctcgttgagggtagtgctgcccgccaggtcctggaaggcttcgctacggaagctctgggcttggtctgcgtagtccttagctgtccacttaacggcgtcctcatacgcatccaggacgtcctccaaggcagagcctttggccttgatgcccagggcgttcatgatgtactcacccagttggcggagcatgctcttaccggttggggatttcgtccgcgccagatgctcaacccactcagggctgtcgcctaagcctgccagcatctcgtgcacattgcttgcgtaataccgcatacgcggcgtcaaggtggagtctgctgcaataacagcgcgcacttcctccaggcgcttagcaatctcgggattactgtcaacggcgcgtgcagtggcggcatgaatcagttcgtgcacggctaccttgctggtgtctgcatccatagcgcgcagtgcgtccccggctgtagtccaggtgctgccattagctcgcttaggtgcgcgtagagatacctccccgcgcctagctaaatcttgttgtgcgtaagtgtagcggctgcggtttgcggagcctgctaccagtttaaaatcaatgtcgtttacagcatcacccagcgtgtccagaatagccttctggcctgctgtcaagtgttcagacttcttcaagaactgaactacgtgctgtgctttcatgttcacggaggcggtattgtttctcgatactaggatgctttcatccagtgtcttagtgagaatttcctctccctctcctactccggtaacattagcatccctcgctgtacgagttgtaggcgcttctgggtcgaacataggctcacgcccagtacgagccttagcggcagctttagcagccctagacatatcccagagctggtctaacccagctacgcccgctatcagtgcagttaccgcggcggactggcccagttggtcctgtgcatagaatgcagtacctacatcagcagcgcgtatggcggtacgtgcagctaagcccgcgcggccagcaataccggcggcaggcatcggggccagtatgaacggggagtcgcctaccaacatacccgcgaacccagccactgtgttgtcagccattaagcggtcacggtcacgctgctcaagcatctgctgcatgcggtagttataatcttcgaccgacaccgagtcgtgtaggtactcaatctcttcctgatttggggcgtacagcttagctcgggtgtcgctactcagggtctgcttggcattaaagttcaggtctcggtcaaatgccggagcagaggccttacgtatagccgcagcgatgatgctgttacccatacccgatgcaaagctctctgcggctgtagtagctggggtcttggcctgcgccagtaaggaggcacgctccagcgcgttcaggccgttatctccagcatcattccaatctacgcgctcaggcgcaggtttaattgttgcgcccttagcagaatccttttcctgtggattcggttctcggttcagaaactgagccataatatctcctaaaagaattttgataaggggaggccccgaagggcctctggttagtgcgttgcttcaaagagccaatcacgtaggttttgttccaggtacttcttacgctcaggttgggcctgcttgtacgcagcggtattccgcagcgcttgccaagccctaccctgggcctcagatacagggtactgatacgcccccaccggggacttagcagccttgcgcacctgtgccatcgcctctgctacggggccagagctaccgttaccgccgtgatagttcaggtccaccatgacctttaacgcctcgtcggaggcagtcaaaccctgtcccttgagttgcttctgcacgttcggtatgtactgcttctccagtgaggatttgaggatactgacaccgtcgtcaatggtcactttctgtgggacgggcatgcccgagttaacgtgcagaccgaaacctacactacccttgcctttgcctccccggaacccttcgaacttcatagtggtagcgagaatgtcgctaaacagcgacggctccagccctaccgagttacggccgttgacctgtacgctgacagcacgcccgttgtcgtggtcgtagaaggtggcgggacgcactcctacttgctcactgccaatcttcatatctccagccagtgccgaatcgtacgcagcctgcgcagtcgtctgaacgtctcgaaggttcacagacatcgtctggaaggtgcccttcttgtcgaacacggttacggtcatgttctgacctgcgttgcccgcagtggcggcctgcactactacacgctctatgttgctgtggtctgacatatactgaacctggttctgtatatgctgctgcagggaggccttgaattgctcttggtcgcccttataatcacccatgatagattgcacagaggtgcccgcgggcagatacacatgcctaggtgccccagcaatgtccagctctaacttacgggattggatattgccttttagcatcgtattgatgtcgtcagcgtccttccctacaagggattccgggttgtgattatacatataacggtactcctcttccatagcagcgcgagcttcctggcgctgggcatctgcatccccgaagaagctaaaccagttggccgtgccacttgggtccaccatcttgtccgtggggttactctggatattgctgtagcgcccactggccttattgcgtgcctggcggcgaaggtcgtccaagatagtgttactggcattatttgggttttgtgtaacagctttctgcaccactccacgccactcagatgggacctcagacagcagcgccatcttccctaagtccgtactggtgctataagcctgtgcccataagttgatgctatttacgttctcgcgggaaacctcaccatcctcaccgagctggtccagcgtagtcagcgtacgtgccatatccgaagacatacgcttgtgcgcttcgttgactgcccacgcatccttgctgttgctcccgtatgccagcagctgcaggttcccttccggggtgtccggaaagcttttgagcagctcgttgcgcgccttacccaggtcgcccttgtacatccccgccagggtggagcttggcatgtttccagtaattgctgtgcgcaatgcctgggtgtccgctgccttctcgcgaatggtctgggccttgttccagaactccatgctggccccagcgctgagcaccccattggttgactgctcaatgattcgaccacggatacgctgcatagtctgctcttgctgctcaggagtctgcccttcaagagactggattgcatcggagatttcgaaacgggcttgggtctcaatctgagcacctgcgcgcttgaactcctgatacagtgccgcgttgacgtccactgagttaaccccgagttccttggtagctaactcttgcagctggtttattaccatcgggtcctgcgtctgctgcgccacgctgaccagatactgcttggcccggtccagcttcttgctcttatccaagtgctcagcagccagtatgctatctaaaccggtcttgatagacatctgcgcagcggcaccctgtcccgcctgcaggcgctgatagaactcatcactggacgagctaaggccgcggtcgagtgcacggtcagcctgcgccagggcaaacgcagctctacctttctggaaggctgtgtagttcgccatgctggtagcacggagctgctgcagtatattcgtggcagactgtttggacatgtccgggagatacatcccgagcttgtctgccattgactgtacgtgctcttgctcctgctgctggaattcctcgtcagtcagaccagactcagcagctttcttagctcgtgcgatgctatctgtgcgccacttggctagagagtcgtacgcggcggcggatacgtagccatcctgataggcctcacgtacgaagatgttctgcttctgtacagcctcatctttggaagccattgcatctactgcgccctgggcatccattgcgccgcgcaccgttgcggctgcagcgttttcttttactgcttcgtcaaaccctacgccgaagtcctgcacgaaccctgacagggcagctaggcgttttgctttggaggtatcaacagacacctcacttaccgttgacggtaagctaacatcgttggactgcagttgcactcctccgatacttaacccctgtctactgggttgaatcacaggcatttgacattcctcttaagttaccaggtatgaactgagctgttacctttgctcccccataaatcataggaggacgccatgttctgagtagctgctgcaccacttccgggtgttgagctaccagagtcagtagacgacgcagcgttaccagcgtactgcccaacggcagatgccccgacactcaacaacgagttaaacatgttatcgtaggggtcctccatgtccatgttagccaggccgctgtccacggccttgtccgtcattagacggaaaccctcttcctgagttgcctgctggtcacgcacgctggcctcttgtcgtccggctacagtgttcactgtggctacggcgtctttaacagaggcccccatagtaccggaagctgctgcctgcagccctacttggctctgtgcctgcagcttctgctgctggatgttaaacagagatacctcagtccggtccctggactgggctcgctgtagcgcgatgtcgtttagctgtttggctgtctgttgaatcacagccttgttcctggccttggacacttcaatctgagcaccatgccccagaacggtcttagcggccatggccgcaaccatccaccacatattaaattctccgtctgcgttggttgtagcgcaggatgtacgagatatccagcacattcagttccatagaaccctcagtaaataatgacacctcggttgtgtctgcgttagtacggcatggcacggtaatcgtagccaggtccatacgcaggacctgcccgagcgtcagctcttttgagttcatcaggatacctgtcagttccccgccccagttgacatcccgtggggtgtctagtacctgcacatagaagtgcccagagttacgtaccgccacatccaggcgcagcaggcgcacgtgcccactccccacgagcttgtcattctggtcccgcagaataggtgtagttagcgtgaacgtactgcggtaacgcctcccgattacgtaggtgccatcaggtacaccgcgtacaacccgcagggtgttctccccggcaatctcctttatgccaacctcagtaggtcccatagggttactgggcaagtaagttaggataagctcttcctcatagcggtcagcccacccaactggacgcagtactgccggaacggtgaataccccgtcctgtacttgaacttgcttctgcaaatccgagtacgcttcgcgatactccgaacccagctggtaaccttcacgcgggtccatagacacaatcaaaagcttgttgctgggactgggcccttgcatgtacaagaacacttcatcctccagcgcttgtacgctcaggattggatacgggaacgaccacttatgccacgccgcctgcatcttagcgccgtcacttccgccccacatgaactcgtagaccagcaagctactacgctccccagacatgcgcgagaaggccatattggtgacactggagttttgcatctgcaataccctgcctggggtataccgcggtaagtgcaccgtagaatcctgtgtagtatactgcgatgaagtatacggcgatgggatcaactcaagaatacccgcgtagctgtcgttgcgcttgttcgggtaaattactgtctgccctgccatgaccggagtaacgcgactatcgcactcataggtgctggtaatgctaatacttgcgttagtgggggtgagcactgctgaacccggcacaacggcctgcatgctgttagcaaacaggaccaggtccctgttaaactgtacagcggtacggtacacagaatcctgcgcagacgcagagctaatactgatacggtccgtatccagcagtgacgtcacagtagagcggtagaagcgctgatacaggcccgaggcggacatatccacagagctgccgctaagcagaaccaggcgaccctggaaagctgcaatgccagtaatgtagccattctcgacgaaccccggattaccgttgttatcgtcgttgcctgctaagcgcccttcccaatcccgcgcaataatattgtcatccgcggcaagttctctgggcatgttcgtaatcttggtgatgctgccgtacgcccccacctcagaccaggtgcgggtgctgtagctgaactgataccacgctgtctcagacgaggctgtacctacacggcacattgctccgtcagcttgcgctgggagctgtgcaggcaggtcctgctcctgatctacacgggactggttggataccccagcgtaagtatcaccggcgtcagaggacaccacgcagttgctcagtccatagaagaacaggtacgcaccgcgtacgctcacgttcccggcgggcatgccattagctacaagagagtcccgcagctgctgagcaacgtaggcacctgatacctcctcagcgttaccgctggtgctgccagcagctggggcggtgtagtcccctgagtagtctacccctgcggaggtaactgtgacgttccagcgtttctggaatgctgcagacttaacgtagaagaaccccgtggtgctggggtcgatacgcccagtattgtccacggttgtgctaggagccatctccgtattcaggatataagtcagtccggcaatgcttgcggtctgcaaagaggtctggcctacggtggtaacgaagtacgggtcgttgccggaattaaggatggtctttccattcttagccagcaaccaccagttaccgttgctggtgttaatcagcaggtgcctaccgtcagtgccacgctcgacgtattcagtgaacagggagtcaagcccagggttatcgattgtgctttcccatacaatctcacccggcggtctacggcggataccggaaaccgggtcgctgagcatattcagctgcgcccccagttgtcctggttggcgctctctcggaacctgctgggaaacgccctgcagcaagctctgaatagtaccttctaatgattgcgccataacctctccttagaccataaaacgagcgcggcggattctgcgtgcaaaacgggtcttgctggtgctgaacttctgattgcgcagatgctcgcgcagcaccatgctcttgtaccgctcagcttcctgtgcgtaattagcgtagttgctgtcaccgcccaggtcatttaagtatacctgcgcagtggtgtagttagccacccacatagcggcgtgctccggcaggtcctcaaaggccaaatccagtaccacacgaatacgcacaggcgcatcgaagtattggttctgctctaccaggtcgtataggttcccgtcacgtaccccgtacttggattctgagcaggcgtcatatacagccagctggttccacggcaccttaatcaggccgtcggtggtgggcgtaacttcacgctcgaccacgttaaaccagaatcctgtgctgagcaacccacgacggttacgtgcaagtgcagagcgagctaatccagcgctagggttactagtgttgatgtccataacgcgggactcccccagggcttccagcgtcaggttcacagcgtctaattctctcatatttgttcctctattaaagaccccttggacctttaagacagggacaaaaaaaaaaaagcccctggcacccgaaggcaccaggggcgcgtattactcttccgcagtatcagcggctgcatcagccgccttacgggttttcttggtagccttgcggccagactcgaccgaggccacctggatgttcttcgctacatcggtggcggccttaaccgcctcccgctgagctgcattggcctggagagtctccagaccgaacgtagcgattactgccattgaacctccaattaggacttggtggtgaaggtgaacttagtcactgcagcggtgtccggacgacgcaggcctatgttgtacatcgcgtagcagtccagtacgttgctgaactcgcgcgtatcgtcccagatacgggaggtgaacggcttagcttcaacagtcaccagggtcttggacttgctgaaagtcaccatacggcacagcgcgtcgtctgcggtgacagtgtaagcagagcccagcggatgcgtaccagcctcggtcgggaactcggtgcactctactacaggtacgccgttcatcttcactacacgacggtctttgtaaccgtcgttgttggacggaccgaattcgatgttcaggagcttcggatgctccagcagacgcgaataggtatcgacatccaccagagtgaccatatccgccagcggggtcttgcgcttgatgagctcatcaataccagccttgtgcgccaggttgatgttcatggcgttagcctccatctcagcctgggtcagctgcgtggcggtagtggtacccggaaccaggatagctgcgcctacctctataccgtcgttgaacgccggtttcaggtgcgccggagcaacccaggaacggcccttgatgagctgaatcaggtgcgcctggtcgaaggtctctgcgaactcagagccgttgttctggcccatctcggttaggaagtccggaccggtccagtcatcctggtagtcaatcgggttacggatatacagcaccgtatccaccacgataatcatcttatcgttacgaaccggggtgctatccagcgcctcgccggagcgacgacccttcaccgaggaggtgttcaagcggtcaatacggtaggtgttagaaccgctgatagagcgctggctggagagtcccaggaatagagcctggtactggaagcgggtatccacttcgttctgatacacttccaggtgaatgtctacgtcagacgccgcgccgccccagtgcggacgagtcaggttgccattataaatagtgttagccatgccttagtttcctttataaataaaattaaagacctacgcgcttaccagcctcacggcgtgcgagcaaatcattataacgttgactgaactgcggagatgccaagctacggttgcccgcttcctgacggagtttggtatattctgcacggaagtccgcagcagataatgcgttgttgctggctacgccccgtaccattgggttctgtgtcttgataagacccatatcccggcagaagcccgctaccaactcagcggcctgcttaagctcaccagcgttagcgagtacacgagctgcgttacgcagaggttcaggagccttggaattaaacagctgtgctgctacctcccagttctccttcccgcccacaatatcgtaagcttcctgcactgccttggtggcttgtccaacctggtcttccaggtacgccttagccaacagctctgcgtaagcagcgtgctcgccgaaacgttccttaatgaaggccgtatcgattaggttagggtcctgatactccagggccttaccaagtgcccgcaccatatcagagtcagttaacccagatacttgcttcaacatagctaccccggcgtcaatcgtcggattgcctgtctgagccagctcctggggctgctccttagcgctatcgccacccttatccagggctgcttttagggcttcgatatccagaggaatcttagcaggttcaggggaatctttgccctgttgctgctgggtaggtgcgggcgcatcctgcacgccttgattgttcggggcgttaaggggagcacctaggcccggaatcttagggccgccttggttctctacctgtgtagtttctacgttctgaccgttttctacgttatccatctatgcccctgttgttaacttggtaataagcccagctgcttacctgctactgttgggtctgctgctgtcaagccctggagttggtcctgtgctgcacctgcggatacatcggcagacgcatcttgaacttcttgcttctgttgcagctgctcttctgtgtacatgaacggctcgctgacgataccgtaggcgtcgaagtaccagtctacgcacgcatccttgttgaagcgtggagtaatctgctccagcaccgggatagccagttgcatggactgcgctgcctctagcagcttatccgctgctgcggctttagccagtgcagaggtacccaccgtaacgttgatgctcactacaccttcgctgaggtacagcttaaagcgaggatataccagtgcagtgtacaggtacgccagcttacgcagccatgtgtcgctcagaatactgaacccgccacccatagcggcttccgcctctttggcattctggcgaatctcgtaagccgtgacgcgctcaccttgccgggagttaccggtgtacataaacgcacgcgacagtttctgttcgagcatctgaatgttgctggcaatccactgaatcttctgggcagagccaccctcgtaagcagtgacgggggatttgctgttcccgttggaaccgccgccgcccacctgcacagcctcgccagtctccgacgttgcgaactcgtccacgtctaacccagagcttgcgtcaatcagcgggattaacctcgcagactcaacctcgtagttagtcaacgcttccgacagtaccgataatctggcgaagtccccggcgtagtcctctaccaagccgcgcccgtagtgttcgccgctaacaaggttccacaccagcacgttgtagggaagctccagctccggataggtgctgctgtctccaatgcggtgcccgtctgcttcttggtacacctcgtagcttactacctctgcaccgtcctctgtccgcttaactttgcgacaagcggcagtgtagatatcaacgtcgccgtatgggtctttgtcacggtagaaggtgttccggaaactctctggcaggtcctggacgcttgcgcgctctctgataatgagtcgcaggacgttaccgcttccatcccttcgaacggtaaagttacggactgaatagacgatggatttacctgtccgctcatcaatatactccaacgcgttacctgtaaccagcagcagcttcacagcctgcaacttcgcagcataaccgtctttctcaaatactttctgtgacgccgtgttctcgacctcggccaacttagattctgccgtagcagcactgcccagcgaactaatgaactcgtccaggtccgaactcttggagaaccggaagaagctagtgccttgcgggaacagcgcgcctacaatcttagtggctgcagtgttgaccagctgcgcccctgtgctctggtaatcacgctccaggggcctgcgtctaccgtccagggaatcgtcccgggtaaagatagtgctgagcgtccactgcgcaaacttctcagaggcatccaagacacccgcgtcctggtccttcttaaagagttctgctaatgttgctttttgttccaagctacccccttacaggcccagaggattgctctgccctgcttgtcgccgtttcttctgctcagacgtaattgcatctgcagatgcagaggcagcccctgctgggtcaatctcagcaatgttatctgcggcgctattagcctctaaggcagcctgttgtttagctgcgctggcctgctgctctgccaagcgctgctgtgcctctaatcctgcgttgtcagtaaggccgagcatatccgtggccttacctaacagtttacctaaaccaccactcattctgacctcactaaatgataagttgtcttgtacgtgttatccgatgtgctccggctaatggcaatacgcccggcgcgcatgcacttggctatcgcgtgcatcccctgcataatcacagtcactgccgcaccattgtccggttttagtacgaagaagtctgtatacagcacaggctctacgtaatgacagtcctccacagcttctggatagtagctgacagcaccgactaatccgccttgggagtcatagactcctagtatatactgtttacccaatatacttcccagcactctccagtagtgctgctctggagccaggccccgactaatgccgtggcccagttcgtgcagttgcttcactgcgtctgtaatgtcgtcagacttatacagaaccttgagagtgtaatcggaagttttactagtgtgttttaacttcattcctactccggtaacttcatttatcagcagaagaagaaaggcgattccagcacttgccggatgtccagggaacctacttctggcatatccaaatccgtcaagtccgccccagctgctgctgccgcgcgagtaatatccccaagcaggtcatgctcttcgtataggctcacaaactgttcgcggatgtgtcggtgcatagcgtcaacgtcagctgcatgtgtagccagcgagtcgtgaataggcacgatgtccaacccttccgcggcacacagaaccatcatcaagtgcgtactgtccaggctatgcacaaagttcggggcaatcccagaggctgccttgcgcttgttacaggtcttgaaatcccggttatgcacccgcatgacggtgaggttcatgcagtcaatgcgtacccgcacttcttcacgctgcgtgtaacggttcattacaagcccacccagcggcgtataccactgcagatgctggcttgccggtacgcgtctagcgaggttctgcaagtaccccataactgccgcagcagctgggttcgcctcttcgatagcggtacgcatacgcggcgccaggtagcacgacaggttccacaggctgttagtctcggcaccctcgtatccctcggcgcaagcaccttcgaagatgtagtcgctgcagctgcgcaccgtagcgctgtagaaataggtcatactggggcgcttggtcatactgcgggtgatttcgttctctctccagtacgtgctctggataacgaaatcctccttgtccaggtccagtatcaccttctcgtccgtacggcgcttcacgtccatgtacaggtcagctttcttatagttaccctcccagtacaggttcgtcagacgcccgcccacagggtctctcaggagcgctgagagatgctgcccacctgagtttgtagcgtccatagcaactgggattcggctaatatgctcttctgggcatccagaacgcacagcattaaccaggtcgatagcggcggccaataggcaccaagggctgtccgcggaggtgaaagcagggcaatcaaacggtgaaactgtaagctgctcaatctctgcaaagttcgcatcaacccaagctgcgcggtcttcgaataaggtcttgtcataaccaaagcatgtggcgacatgcaccttgagccagaataagccgcgatcacccagaggttttcctctgccaaactcaagaagggctttctgcaaatcagaaccttgagggtgcagcgaggacttgaagtacaaccggtaccgccaatccacgcaggttgggaagtacagagctttctcatctttgaattcctctgccatttctaacgtagtcaaaaggctgcgcagttgcgacacacgcttacggtctgcgctgtaccacagggacatgcgcgtcttccactcaccaaaacggtcaagctcttcctctgtgtagttctcttttggaacaccatccaagtaccactccggtttcggctccggtactgagcgcggcatgcctatcccaacacccatggcccgtgcttcttgcaccagttccagtatgcgcttattaatacggtacggggtttcctgtgccttattaagcgcttttttaatgccatccgcggacttaaatgcttccgctacttcacggagacgagctctgtcaatgtgcgagttatgataggtcccgcgattgtcgataggggtgaggtatccaccatcccacagagtagtgtgctgcaccggcggtaccagcataggcggcttcatggttacagtgtcagcggactctaccagtttctggaaggcctccataacgtcgtcagccggatagagcatgctcagattcccgctacagttcttccactggaacaggcccgtctcaaacaccgcggcacacagcagacgccctacggagatgttctgggcattggtccaaggctcgtgcccatagtgcacgttctcggcactggcgcggagcgtacgcaggatgtgcgtaggggacttcgtacggcgctctgtgaggtactcatacacacggtccatgtacgcaggggctacgttgcgtaactgcagagccagtagctctgactgtacgtttctgcccagtgcggacattaccgcctgtgcagtctgacggcgactggcggactcgccaggggcgacgctgaacgcctcaaacattgtgcacaggctcagagtggtcaggacgtccaaggggactaagcgcaggaaccgtcggtacttaccaccaatgcccggggctttgacatttcgcatctcatcgatagcggcagcagccacctcatatgccgaggtgagcatacgctgcgtcatcggcaggttcataatcccgccattctgcagtgcgtccgtaatcagcttacgtgcccgctcgattccgcgaatcttataggtctcttcaagctccagctggcgcttcaccagtgcttcctcgggtactacaaccgtattcagggcgctaatcataggcgcttagtctccttggttatgtccggtacttctaactactgattgcgactcacccagagattgtacatctccagatagtctttagcggagctttcgtcgccccgttctactgctttctgccacatcccgtggcaccatgcgctaggcgtcaatgcacttacctcggtgttgctcgtacagttctgagtacttgtcggacttggcaatgtcctgctccagcttatccttgttcccggcgcgcagtctgtacttgagccggttccccaggcagtatccgtagaactgctctttcgtcatactgcgtgcaatcacctcaattgcctccaggtccgggaagaactggtagtgccgaggagagttcactgagtcagaaacagcctcgctcttcgaatggaagagctggaagaactccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaatagtctcccgtgctttgcgtcgtgcccgggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatatgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaatccatccgaatgggtcctccagtgcaggccacactgtacctgtcggtatatcgaaccgagccatagggctgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcctgcaggcgtcaggtacgccactgcctctgagcagccgaccaggaacatgtcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcgtatgcacggcgccgggacttggcgcactggcgattcaagtgataacgctgcgcactaatctcgggacccagaaggcttgccctgtatgcgtgagagctagctacccagcgccagtcgtctgctcgcttctgcaaacgctgtgcgcgcagaagcagaaacacagcgtactgttctttggcccatgtgattatgcgcatttatacccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaaactgcgctttggcatctgctcgtttagcttctgctgtgtaggctgcactcaggagtttgatgagaatgttgatgatgttcatagtcttcctctaaggccccatgcggggccatattagtttaggttagggtagattaggcttgaggtgcagcaggcgcagcgggcgctacaggagccgcaggagccactggagcagctggggctgcaggtgcttgcggtgcagcgggagccgccggtgcagaaggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgtaggctgtcccaggtctctttggttgggttgttccacaggaacagcttaatctcagaggcatccagggctggcatcttgataggctcgccggtgttcgggtcgaacttcggaatcgggcggataccggacaggtccacgatgttagacttcttgcccgcagcactggtgtgctcatcaatcgggaaggtgaaggcctgccccagacgctgtgctgcatgcttaatgctattgtcgtagttgagcttgtcgaagaacttcttgaagcctgctcgctcaaagttactgatagccatcgggtacgggcggatacgcttcacttcaccgttaggaccgtacaccacaataccgatgcgcacgttagccactgcaggcttaccagtaggcttaccgcccttagttggtaggcgcttaccgatttctacgtactcggtgaagtagccgtagtattcgcccttcggaagcagtacatcctcatacgcaccgccctgtgaggtttcccgcatatctacatcttgggtttcgattgctgcgtctaccagagcgttcaaggatgccagtacattagtagtcatataatttatacctcgttagaaaagtgtttgtgatgctgagagataactgcttgccttgctaagtgggcctcttctgcggtagcgtagaatcctaggtggtattgtaccccatctgtttgtatgtaggcacgccacttaccattgcttttacgataagacactccacgataccccgaccgggaatccttccgcaatcctgcattcttcgcgtttcctgctttattggcctcccttaaattgacccaccgattatctgtacggtttctgtttacgtggtctataacgttcggccaacgtccgcacattaaggcgaaggccagtcgatgtgcaaagtattgcctacccttcacacttactaccctgtaaccatccttaatgtaacccacagcctcggaaccgtcaggcctatgcaatttccccgattcggggtcataccgcaaatattgcggcagagaagtagcgtgcatataccctctcgtttagttcaaatgatatttacgtgcagatgcaggacaggcctagcgattcttaagtgcggacttaatgcctgcagccgcggctgccgccacaccgcctgccgccaggattgccaacagcaaagctacaccgccgtagaacggaagcagcacccacagccaggaccaggc

SEQ ID NO: 161 - DNA, 44676 bp, Unknown
  source: /note="Description of Unknown: MCoc6c Bacteriophage Sequence"
gagcacgcagaagaacaccctgtgcacgggttgattctcactgagtatgcagccgattgcttgggggagaagtatctgggcaacgacgatgaagaaatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggcgcgcccaaccagcgctgcaccggacgtcggctgcactaacaagggcgtgctgttcgtaaagaatccgcaacaagctgactgcttgggggcggactgcggtgctggtatctacctgatgctggagatgctgcggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgcccccagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctaatcacaaagggaatcatgcctgaaatggtgggggatgcagaatggagcaaagagaaacagcggataatcttccgtgtcggaagggctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacatccatgactgtattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcattggactctggcggagattaaggaccggcacagtaagcaagagttcgtgccagcctacctcaagaaagtaggcagggctgaccggattcgtgttaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgacgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgctgatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctgtatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaatttcttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgcgctacgttcgcccagcgcaatcagatgcagtacgtgtgggagcgcatggatgccttgctggcttgggcgtactgcgaatggttcggcctgttcgtgaatatgccgattgctcgcaagaaccaagaagagcaggagcagcgcatcctggagattaagcaggagctgcagcagtacatcccgaaggacttgccggagacgctggatttcaacttcggttcggacttccatatgtctgcactggtgtacggcggacctatcaagtaccgcaagaaggttccatatttccccccgcagtatgtcaaggcagactattggcaagtcggggacacttgggttgccgtggacgacatgcccgcgccacccggtgcaaccacgtacaagtccggtaagaacaaggggctgccaaaagtattccgccttgatacagaggaggagaaacttaagtgggaggatgacctttacttctgtccgggcctagtggacatccaggagcttccggaagttatccgggagaagtacgcagagcgcggagagttccggcaggcgcgtaccctgcatgacggcacgccagtatacagcaccagcactgacgcaatggaggcactggctcgccaagggttcgagttctgtaagttggtaaacgagctggcggcgcttgagaaggacactggtacttactatttgcgggaagttctggatgcaaacggagaagtcaaagagcggaagggaatgctgcagtacgtaatccctgaacgtcctgatggttccggaatcatacaccaccgcctgaatacctgtgccaccgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcctgctacaggcaggtacggatatgcactgttaccgcctagctttccgtgaaggattaccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatataccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtgcacgatgcgctgtacctggacagcgccaacccagaggttggacgtgaggcgagcttgctggttaagcagtgcatggaggacgcacctaagcgtatccaccagctctggcctaactacggtatcattggtgaggtcccgttcccagcagaggctgagatgggtacgagtatgtacagtaaggagaaggtagaatgagtataaagtcaggcagtgttgtggagttgatggatcttgggcctgagccgatagacccgaggtatgcagcatacttcaccccaggtacaaggcacacggttatattcttcgacccggttactggtgagatagaactaagttaccctggactgttagtaagtaggcccggggacggcgtcaccttcttccccggggagtacaagcttatcgaagagtagtgataggtgtacccttgggtggtgtagggggttagggtagcatggaaatatgctagggtcaactaaataattaaataaaattatttgttgactttggcttgattctgtgattcccctagaattaatgtgatacgagtaggaacaacacaagagaggcaataatggcacgtgttagcctaataaaactattcaccaaagagcagcaccaggcaatcctgggccagtacctagacaacgctctggctgctcagtactacaaccaagagctggataatcgcggggatgtggacacggacattagtgtatctcgtcagcttgtgcgctattggcgcagcatcttcatggataacaagggcagcaaggcaaaggctaataatgctttgatgcaagcccgcaaactaatccagccctccccaacggatgacattggggatacgtttgtaccggaaacctgtcgacgtattctcgttatcggggacctgcacgagccgtacacacatccggacgcgtacgactttttgcgcactgtacgggacgagtactgcccagacattgttgtgcagataggcgatgagacggatgggcacgccattagctttcacgacagcagtccggagttggatagtgctggggtggagttagagaaggccaagcttggcctggagcggctgcataacctgtttcctaacctgctcctgtgcgactctaaccacggctctcttgtctaccgcagagccaaagctcatggactccctgtacagttcattaagaagtaccgggacatcctgttcccagagcatggggcccccgggtggagttggggcgatgcttgggatttgaatactccactgggtattgtgcgattccaacatcaagtatctggggacctgctgctcaacgcagcccatgaacgtaagtccatggtgattggacacttccatgggaagttagatatacagtatgccgctagcagcactgccctgtactttggtgcgcactgcggttgtttaatcgacaacaagagtctggcctttgcttatggtaagttgtcaagaagcaagccgattctagggtgtatggtgattacagatggatgcccgcaaatcatccccatgttacttgacgattccgggaaatgggtagggagaagcaaatgaatttgctagacgcaaccgtcacccgagtgggtgcgcccgtatgggatgagcaataccaggtgtatcgtgtaaccctggagtatgactgctgggggcacaaatctgagacagagcggtggtataaagatgaatcctcagctctgagtttaaaagttggcgacataatcaaaacctaattaggggtaccaatgaaaatgggaatctgttctgtactgggtcttatctttataaccttgaaactgaccggggttatcgcctggtcctggctgtgggtgctgcttccgttctacggcggtgtagctttgctgttggcaatcctggcggcaggcggtgtggcggcagccgcggctgcaggcattaagtccgcacttaagaatcgctaggcctgtcctgcatctgcacgtaaatatcatttgaactaaacgagagggtatatgcacgctacttctctgccgcaatatttgcggtatgaccccgaatcggggaaattgcataggcctgacggttccgaggctgtgggttacattaaggatggttacagggtagtaagtgtgaagggtaggcaatactttgcacatcgactggccttcgccttaatgtgcggacgttggccgaacgttatagaccacgtaaacagaaaccgtacagataatcggtgggtcaatttaagggaggccaataaagcaggaaacgcgaagaatgcaggattgcggaaggattcccggtcggggtatcgtggagtgtcttatcgtaaaagcaatggtaagtggcgtgcctacatacaaacagatggggtacaataccacctaggattctacgctaccgcagaagaggcccacttagcaaggcaagcagttatctctcagcatcacaaacacttttctaacgaggtataaattatatgactactaatgtactggcatccttgaacgctctggtagacgcagcaatcgaaacccaagatgtagatatgcgggaaacctcacagggcggtgcgtatgaggatgtactgcttccgaagggcgaatactacggctacttcaccgagtacgtagaaatcggtaagcgcctaccaactaagggcggtaagcctactggtaagcctgcagtggctaacgtgcgcatcggtattgtggtgtacggtcctaacggtgaagtgaagcgtatccgcccgtacccgatggctatcagtaactttgagcgagcaggcttcaagaagttcttcgacaagctcaactacgacaatagcattaagcatgcagcacagcgtctggggcaggccttcaccttcccgattgatgagcacaccagtgctgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcaccgcaagcacctgcagccccagctgctccagtggctcctgcggctcctgtagcgcccgctgcgcctgctgcacctcaagcctaatctaccctaacctaaactaatatggccccgcatggggccttagaggaagactatgaacatcatcaacattctcatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgccgtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctgcgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctatccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgaagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgaacagtttgtgagcctatacgaagagcatgacctacttggggatattactcgcgcggcagcagcagctggggcggacttgacggatttggatatgccagaagtaggttccctggacatccggcaagtgctggaatcgcctttcttcttttcatgaggatattatgcctaaacaactactgccgcatttagaggaaatacaacgtcgctatacgtacaacccagagacgggcgcactatgttggcgcataaaccagcgcggcgcaaaggcgggcagccccgccggaagtgtgtacagtaatggttatttaatggtgtacgtggccggacagcccaccctggcgcacagggttgcgtgggtcctggtcactggggaagagccaccggatgtgatagaccacgcggacaggaatcctctaaacaatgcttggaccaatttacgcgcatccagtatgcgtctaaaccaaggcaacaggacccctacaagaggtcgcaagctacccatgggcgtacggaagcaggggaacaagtacgccgcaaggatgacccaaagaggtgccagtatccatctaggcaccttcggtacaatacccgaggctgaggccgcataccgcaaagcaaaggccgaatacttctgctgataaatgaagttaccggagtaggaatgaagttaaaacacactagtaaaacttccgattacactctcaaggttctgtataagtctgacgacattacagacgcagtgaagcaactgcacgaactgggccacggcattagtcggggcctggctccagagcagcactactggagagtgctgggaagtatattgggtaaacagtatatactaggagtctatgactcccaaggcggattagtcggtgctgtcagctactatccagaagctgtggaggactgtcattacgtagagcctgtgctgtatacagacttcttcgtactaaaaccggaaaatggtgcggcagtgactgtgattatgcaggggatgcacgcgatagccaagtgcatgcgcgccgggcgtattgccattagccggagcacatcggataacacgtacaagacaacttatcatttagtgaggtcagaatgagtggtggtttaggtaaactgttaggtaaggccacggatatgctcggccttactgacaacgcaggattagaggcacagcagcgcttggcagagcagcaggccagcgcagctaaacaacaggctgccttagaggctaatagcgccgcagataacattgctgagattgacccagcaggggctgcctctgcatctgcagaggcaattacgtctgagcagaagaaacggcgacaagcagggcagagcaatcctctgggcctgtaagggggtagcttggaacaaaaagcaacattagcagaactctttaagaaggaccaggacgcgggtgtcttggatgcctctgagaagtttgcgcagtggacgctcagcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgccgcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacaggggcatagatggataacgtagaaaacggtcagaacgtagaaactacacaggtagagaaccaaggcggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcaccccggttcgtaacgataagatgattatcgtggtggatacggtgctgtatatccgtaacccgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacataggcctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgtggaagagtaatacgcgcccctggtgccttcgggtgccaggggctttttttttttgtccctgtcttaaaggtccaaggggtctttaatagaggaacaaatatgagagaattactaatgtacgaccctactagcccaagcggattacgctggagggttgatgggtacagaaacacgtacagggccggtgacgcagccggatgcactcactcaggacccacggggtactatcagatagttatccgcggtaagaagtatctaagtcacagggtggtgtactttctagtacatggggagtggccagacaccgtggaccacataaacggaaaccgcaaagataaccggatagagaacttgcgcgcggctactgtacggcagaatctgtgcaacttaactaaggccagaggattctactttgccaagcagcagggtaaattcgtggcgcagatatgcaaccacggtaagaatagaacaattggcagctttgatactgcactagatgctcgtgcagcgtacttgcgcgccaaacttgaagagcacggtttcgtgccgggggtggtttattcgtgaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgtggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgctaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacgggatattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttctatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcatacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgtgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggtagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagggttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtcttcggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggagtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattacaagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcagtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggccaagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccgagaaccgaatccacaggaaaaggattctgctaagggcgcaacaattaaacctgcgcctgagcgcgtagattggaatgatgctggagataacggcctgaacgcgctggagcgtgcctccttactggcgcaggccaagaccccagctactacagccgcagagagctttgcatcgggtatgggtaacagcatcatcgctgcggctatacgtaaggcctctgctccggcatttgaccgagacctgaactttaatgccaagcagaccctgagtagcgacacccgagctaagctgtacgccccaaatcaggaagagattgagtacttgcacgactcggtgtcggtcgaagattataactaccgcatgcagcagatgcttgagcagcgtgaccgtgaccgcttaatggctgacaacacagtggctgggttcgcgggtatgttggtaggcgactccccgttcatactggccccgatgcctgccgccggtattgctggccgcgcgggcttagctgcacgtaccgccatacgcgctgctgatgtaggtactgcattctatgcacaggaccaactgggccagtccgccgcggtaactgcactgatagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatcctagtatcgagaaacaataccgcctccgtgaacatgaaagcacagcacgtagttcagttcttgaagaagtctgaacacttgacagcaggccagaaggctattctggacacgctgggtgatgctgtaaacgacattgattttaaactggtagcaggctccgcaaaccgcagccgctacacttacgcacaacaagatttagctaggcgcggggaggtatctctacgcgcacctaagcgagctaatggcagcacctggactacagccggggacgcactgcgcgctatggatgcagacaccagcaaggtagccgtgcacgaactgattcatgccgccactgcacgcgccgttgacagtaatcccgagattgctaagcgcctggaggaagtgcgcgctgttattgcagcagactccaccttgacgccgcgtatgcggtattacgcaagcaatgtgcacgagatgctggcaggcttaggcgacagccctgagtgggttgagcatctggcgcggacgaaatccccaactggtaagagcatgctccgccaactgggtgagtacatcatgaacgccctgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccggatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcagaggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcgaatccggtagcacatcccctgcgcggaatctgcgtcagcgtactcggttcaacatggacaaagagtatctggtgaacggtaagagcatgcgcatgcaggacctgatggatactgatgtagccaaggttatgcacgggtacactaaccgtatgtctgggcgtgtaggcatggcctatgcaggcgtacaggacctgggacagctcgttaagatgattgatgagtctaagcacgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcaagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaatgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacgggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacagtggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaaagtctgccgacgctatcctggatacccgagtaactaatctagagcagacctttatatccgacagggtcactgtaagctacccttggtttacagtactggatacccccacagacaccgtgacgccgcccatcgcttttagtaaggccatagttgagctgaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggcctcagtaggcgaactggcgtacaagggcccggcaaacgccgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacattgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccctactcgtggggaccgtacttcattagaaggctatgatgtcaactgcgacctgaaaccgctggataaatccgccagcgtagcctgtgtaggtatcactgcatccctgcaggggaagcgcgcggacctgctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcactgattgagaaggagctggacttcggtccggaaggcttccagctgcagtacatgctcgacactacactgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatccaggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgcaatcgctatgatggtggctacgctgaacgggcacctggtggaagatgagaaagtggtggctgagcgtgagtctgagaagatggctcgggccttcattgagaacccgctggattgggcacagagcaaagtgtctaagggccttcggggtgtggctgctaggttgcagaaccgtggcagagataaacaacatagaggaagaagataatggcatttgcagaagcaacactggcacagcgccaggcagtacgtaatgcggcagtggcgcttgataaagcaacaaccttggcgcatgataccggcccactagatactctgggtccggatgtagatgcagcaggggctgtagcagtggcggcactctctgctgcaggagcctctgacggtggtgctgtagtggtggttggtgacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcaccggtacaatccaggcagagcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtgtcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcagatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacactgagcctggatggtattacagtagagcgtgctcgttctgttccatttagccttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagctcctacaaagttactctgtttaatcctggggctgcggcaattacccctggggctactcgggctagcttggtgctgcacttctaacgcacagcgtaaagcccaggcccagtctaggcgagcaggtctatacctggacctgaaatttattagactcacgcgagcccctccctcaccctgaacgcgcccaattgcccccatagggggtacctagcgtcaatttagggggggggggggcactgggtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcctgtccagcggggccagtagtggggccatagtgggccagctagtgcgctgtagtgctgtccctagtgctatccctagtatgcactaggctatccactggctatccttagtgctttacattgcgcggattctgtgctacgctgcgcgctccccactagggcgcacatccactatcccagcgctatccctttgctcttactttcattcgaaagctattatgaaatgaagtaaccggagtaggaggggtttagggcactatatacactactactcactagtactcactagtaatgccctgtatgaccgaccgtagggagggaagcattaactacgctacactacgttccttcacttacgttacgtcactacgctacgctctatgcagtactatgcagtatggttagtagtggttagagtacccctagagctatccctagtgtggttctaagtgcagctctaagtatttgccctgcttaccctttttgctcttagtgataaaaagttgaaaatattacttgcttcttttggttcaatggggctatagttcaatcaccgggaggcgctgaggtgctgaacggagccgagccgggaggctccgccggattaaggctagatagtgtgaagggttagacactcgataaaaagagttgacaccgcgaagaacataagctagattgaatcccaaagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattaactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactctatggttaatgtattcaacatcattgtgaccagcgctatgctggtgctgggaaatgacgcaagcaacccggtgccctactgtactgtgcaattgcagcagccagcaacacagcaactgcagccacgccctgagtacgacctattcgaatacccggagggcggctgcaaagagctgggtgcgcgtatccttgcggcggtgcaggagcagtacccggacgccgcggtgacgctcactgtggatggtaagagcaacaacgaaatttgagaggtgttggcggctatgaaagtcttaaagttcattcgtaaatctgaggcgttgcgtattgcggatgcaaatcccggcgctatcaagtacccatattgcactggaaagtacaagtccttgcctgcaagatacttgggcgaagaggtcaaggtttccgatgacgtagtagctgtgtatgcagagcgccgctatgatagttttgggccttacactaagctcatgtgcgtgcgccgtgtcagtgggggtacggcatgaaggcttacggaaagaatcctgaaacgctgctgatgcgtaagcagcaaccaacaatcgacgggctggcgcgggagtacagcgcaaaggcgggactgcgacagcactatgagaaacaagcaaagcgactgggtatgaccctgcgcggctactgttaccggtttaatgtgcggggtgtagtatgaagtatgacgtgtaccgggagacctatagcggtctgtattatctcatccctttagaaggggcaattaatgagcgccgcatacttttaacctctgcgggattaatgcggagcagttaccgagcaggtgacgttatcacctctccggcttttgtgttggtggcacgaaactgcgtgactaagagaagcctatgctaactgtagacgaaaccgcggcgtttatctggcgcttgctggagacacaaggcaagtgcgggtgtccgtgggaaacattcaaagaggttcctaatgagctcaagaaaatcgtaccagtcgagcgtagactcctccgagttcgtaagcaggactctgcggtggtgctccccacgtaccgcgagtatacagaatctgccgcgcggcagttgcaagagcacattgagtttgatgtggtcgcagcactactacggtacgggtatcgtggagcctatacaagatttagggcggctgtgcgctcatattataagcaacgacaactcgctgcgtggtatgcacgctgagctattaatacacgacgcaatacaattaactcgggagcaaatgaaaatgcaagagactatcaaagaaactggcacagcacctatcgaatggaaagtagtgttgccggaaggtgcaaacgcactgccaatgaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgcaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaagacctcaaggctatgaacgtagaccctacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctacaacggcgcagtgctgatgccatatctcgatagcagccagcgtggcgtagacgaagaaggcagtgacgcctttgtaatacgtgacgactacgagtacgaggcgcaagaatcagaagggtacatctacgtcggcacagaatctgctcggtgctgctgctgcggggggcgctactccgttgatgatatgcacgaaaccgccgattatgaaatggtctgcgacggctgcctcgaagagggggagtttgtatacgtagttgggcgcgagggtctgtataatcgatggagttgcacttggtctgattaccacgacgcttatgtatacgacggagacattgagcactgttcggtagagggggtagtgcatgaccaagaagaactggtgtatgcacaggaccgacaggtgcttatt

SEQ ID NO: 162 - DNA, 43728 bp, Unknown
  source: /note="Description of Unknown: Mcoc7c Bacteriophage Sequence"
ctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatggaagagcgatatggaagtacacttgctccttatatcctggagcttattgagcgcggctataaacgcaccggcttcggcgtcgacgggacgctaggcgagagcacggacaccggacgctacgacgaggatgcactgattgagaaggagctggacttcggtccggaaggcttccagctgcagtacatgctcgacactacactgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatcccggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgcaatcgctatgatggtggctacgctgaacgggcacctggtggaagatgagaaagtggtggctgagcgtgagtctgagaagatggctcgggccttcattgagaacccgctggattgggcacagagcaaagtgtctaagggccttcggggtgtggctgctaggttgcagaaccgtggcagaggtaaacaacatagaggaagaagataatggcatttgcagaagcaacactggcacagcgccaggcagtacgtaatgcggcagtggcgcttgataaagcaacaaccttggcgcatgataccggcccactagatactctgggtcctgatgtagatgcagcaggggctgtagcagtggcggcactctctgctgcaggagcctctgacggtggtgctgtagtggtggttggtaacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcgccggtacaatccaggcagggcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtatcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcagatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacacttagcctggatggtattacagtagagcgtgctcgttctgttccatttagctttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagctcctacaaagttactctgtttaatcctggggctgcggcaattacccctggggctactcgggctagcttggtgctgcacttctaacgcacagcgtaaagcccaggcccagtctaggcgagcagatctatacctggacctgaaatttattagactcacgcgagcccctccctcaccctgaacgcgcccaattgcccccatagggggtacctagcgtcaatttagggggggggggggggggcactgagtgggcctgctagtgcgcaccagagggcctcagcgggcctgtgctgcgttctagggctatcgctagtgctaccctatggctatccctgtgcgttcactagggcgcttcctgtgcgctctatggggcactagggctatccccgcgttatccctgtgcgctccctgtgggccataggggcgtgctctgccttgcttattttgtgcctgtccagcggggccagtagtggggccatagtgggccagctagtgcgctgtagtgctgtccctagtgctatccctagtatgcactaggctatccactggctatccttagtgctttacattgcgcggattctgtgctacgctgcgcgctccccactagggcgcacatccactatcccagcgctatccctttgctcttactttcattcgaaagctattatgaaatgaagtaaccggagtaggaggggtttagggcactatatacactactactcactagtactcactagtaatgccctgtatgaccgaccgtagggagggaagcattaactacgctacactacgttccttcacttacgttacgtcactacgctacgctctatgcagtactatgcagtatggttagtagtggttagagtacccctagagctatccctagtgtggttctaagtgcagctctaagtatttgccctgcttaccctttttgctcttagtgataaaaagttgaaaatattacttgcttcttttggttcaatggggctatagttcaatcaccgggaggcgctgaggtgctgaacggagccgagccgggaggctccgccggattaaggctagatagtgtgaagggttagacactcgataaaaagagttgacaccgcgaagaacataagctagattgaatcccaaagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattaactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcaggaccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcgggtatacgcagaatacaactacactgtggtcatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgcagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgcaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaagacctcaaggctatgaacgtagaccctacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctacaacggcgcagtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagagggggtagtgcatgaccaagaagaactggtgtatgcacaggaccgacaggtgcttattgagcacgcagaagaacaccctgtgcacgggttgattctcactgagtatgcagccgattgcttgggggagaagtatctgggcaacgacgatgaagaaatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggtgcgcccaaccagcgctgcaccggacgtcggctgcactaacaagggcgtgctgttcgtaaagaatccgcaacaagctgactgcttgggggcggactgcggtgctggtatctacctgatgctggagatgctgcggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgcccccagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctaatcacaaagggaatcatgcctgaaatggtgggggatgcagaatggagcaaagagaaacagcggataatcttccgtgtcggaagcgctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacgtccatgactgtattgcccggggtagggctagacgtggagtttctaaaggggagcagaatgggtactccaagctaacagcgcagcaggtggactatatcaggaagacctacaggcggcacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcattggactctggcggagattaaggaccgacacagtaagcaagagttcgtgccagcctacctcaagaaagtaggcagggctgaccggattcgtgttaaggctgcgcactcattgacgatggcgcagatatccacgctcatggaggagatgcgccccgcggtaatcatcatcgacatggtggcgaatatccgtggtggcactatggagagtgagcaccagaaccttgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgctgatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggaggatttatgcaagtagactatacaggggttatccaaaaagtggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgacaggttgtattgaccacggacagaggggaagcacttgccgaggaaagggcgctgggtatggccgctccagatttgacgggaagacaactggcagccaccgcaaagcatactgtatagcccacaacttgaagctgagcgatatcgcgggacttgtagtccggcattcgtgcgacaatcctcggtgcataaatccggagcacctgctactagggactcctagcgataatatgcaggaccgaaataaaggtgcgcgtaatttgctgggcagccgcaaccctgctgccagacttaccccagaagacgtgcacagcatacgagaagcatacgctggcggtgagacccagatatctatagcgagacgcttcggaacaagtcaaggatacatatctaatatcataaaggggagggtatggaatgagcagaagcatcctgataacggattatgagacgcaaaaccacccatattacggtagtgttgcttccccgtactgtccggataattacatcgtagaatcagcgtggcgtattgaccgcacgcacgatgacggtacggtagaagtaggccccgtagagagtgtacggtataacagtcgcgcgcactttgaagcggcacctgtatcagaatggctcccaataccagctgactgttggctgattgtggctcacaacgccgcatatgagattagctggttcctaacctttgcgcgcgccgagtttgaggccttcctaaagcggggaggtcgcgtattctgtacgatgcattctgaatacatcgcctcggactttcagagcatgtatccgtcgctggacgagacggctcctaagtacggtggtacgcacaaagtagacggggttaagcttctgtgggagcagggtgtgctaacctcccagattgacccgatgctactgcacgactacctggttaacggggacatcccgaacacggccctgtgcttctacggccagtgcgctacgttcgcccagcgcaatcagatgcagtacgtgtgggagcgcatggatgccttgctggcttgggcgtactgcgaatggttcggcctgttcgtgaatatgccgattgctcgcaagaaccaagaagagcaggagcagcgcatcctggagattaagcaggagctgcagcagtacatcccgaaggacttgccggagacgctggatttcaacttcggttcggacttccatatgtctgcactggtgtacggcggacctatcaagtaccgcaagaaggttccatatttccccccgcagtatgtcaaggcagactattggcaagtcggggacacttgggttgccgtggacgacatgcccgcgccacccggtgcaaccacgtacaagtccggtaagaacaaggggctgccaaaagtattccgccttgatacagaggaggagaaacttaagtgggaggatgacctttacttctgtccgggcctagtggacatccaggagcttccggaagttatccgggagaagtacgcagagcgcggagagttccggcaggcgcgtaccctgcatgacggcacgccagtatacagcaccagcactgacgcaatggaggcactggctcgccaagggttcgagttctgtaagttggtaaacgagctggcggcgctcgagaaggacactggtacttactatttgcgggaagttctggatgcaaacggagaagtcaaagagcggaagggaatgctgcagtacgtaatccctgaacgtcctgatggttccggaatcatacaccaccgcctgaatacctgtgccaccgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcctgctacaggcaggtacggatatgcactgttaccgcctagctttccgtgaaggattaccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtgcacgatgcgctgtatctggacagcgccaacccagaggttggacgtgaggcgagcttgctggttaagcagtgcatggaggacgcacctaagcgtatccaccagctctggcctaactacggtatcattggtgaggtcccgttcccagcagaggctgagatgggtacgagtatgtacagtaaggagaaggtagaatgagtataaagtcaggcagtgttgtggagttgatggatcttgggcctgagccgatagacccgaggtatgcagcatacttcaccccaggtacaaggcacacggttatattcttcgacccggttactggtgagatagaactaagttaccctggactgttagtaagtaggcccggggacggcgtcaccttcttccccggggagtacaagcttatcgaagagtagtgataggtgtacccttgggtggtgtagggggttagggtagcatggaaatatgctagggtcaactaaataattaaataaaattatttgttgactttggcttgattctgtgattcccctagaattaatgtgatacgagtaggaacaacacaagagaggcaataatggcacgtgttagcctaataaagctattcaccaaagagcagcaccaggcaatcctgggccagtacctagacaacgctctggctgctcagtactacaaccaagagctggataatcgcggggatgtggacacggacattagtgtatctcgtcagcttgtgcgctattggcgcagcatcttcatggataacaagggcagcaaggcaaaggctaataatgctttgatgcaagcccgcaaactaatccagccctccccaacggatgacattggggatacgtttgtaccggaaacctgtcgacgtattctcgttatcggggacctgcacgagccgtacacacatccggacgcgtacgactttttgcgcactgtacgggacgagtactgcccagacattgttgtgcagataggcgacgagacggatgggcacgccattagctttcacgacagcagtccggagttggatagtgctggggtggagttagagaaggccaagcttggcctggagcggctgcataacctgtttcctaacctgctcctgtgcgactctaaccacggctctcttgtctaccgcagagccaaagctcatggactccctgtacagttcattaagaagtaccgggacatcctgttcccagagcatggggcccccgggtggagttggggcgatgcttgggatttgaatactccactgggtattgtgcgattccaacatcaagtatctggggacctgctgctcaacgcagcccatgaacgtaagtccatggtgattggacacttccatgggaagttagatatacagtatgccgctagcagcactgccctgtactttggtgcgcactgcggttgtttaatcgacaacaagagtctggcctttgcttatggtaagttgtcaagaagcaagccgattctagggtgtatggtgattacagatggatgcccgcaaatcatccccatgttacttgacgattccgggaaatgggtagggagaagcaaatgaatttgctagacgcaaccgtcacccgagtgggtgcgcccgtatgggatgagcaataccaggtgtatcgtgtaaccctggagtatgactgctgggggcacaaatctgagacagagcggtggtataaagatgaatcctcagctctgagtttaaaagttggcgacataatcaaaacctaattaggggtaccaatgaaaatgggaatctgttctgtactgggtcttatctttataaccttgaaactgaccggggttatcgcctggtcctggctgtgggtgctgcttccgttctacggcggtgtagctttgctgttggcaatcctggcggcaggcggtgtggcggcagccgcggctgcaggcattaagtccgcacttaagaatcgctaggcctgtcctgcatctgcacgtaaatatcatttgaactaaacgagagggtatatgcacgctacttctctgccgcaatatttgcggtatgaccccgaatcggggaaattgcataggcctgacggttccgaggctgtgggttacattaaggatggttacggggtagtaagtgtgaagggtaggcaatactttgcacatcgactggccttcgccttaatgtgcggacgttggccgaacgttatagaccacgtaaacagaaaccgtacagataatcggtgggtcaatttaagggaggccaataaagcaggaaacgcgaagaatgcaggattgcggaaggattcccggtcggggtatcgtggagtgtcttatcgtaaaagcaatggtaagtggcgtgcctacatacaaacagatggggtacaataccacctaggattctacgctaccgcagaagaggcccacttagcaaggcaagcagttatctctcagcatcacaaacacttttctaacgaggtataaattatatgactactaatgtactggcatccttgaacgctctggtagacgcagcaatcgaaacccaagatgtagatatgcgggaaacctcacagggcggtgcgtatgaggatgtactgcttccgaagggcgaatactacggctacttcaccgagtacgtagaaatcggtaagcgcctaccaactaagggcggtaagcctactggtaagcctgcagtggctaacgtgcgcatcggtattgtggtgtacggtcctaacggtgaagtgaagcgtatccgcccgtacccgatggctatcagtaactttgagcgagcaggcttcaagaagttcttcgacaagctcaactacgacaatagcattaagcatgcagcacagcgtctgggccaggccttcaccttcccgattgatgagcacaccagtgctgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggatagcctgcacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccggctgcccctgcggcagtcgctgctcaggcagcaccggcagcccccgctgctccagcggctccagcggcccctgtagcgccagcagcgcccgctgcgcctgctgcacctcaagcctgagcgataacccgcgtagtcaacaggtacaaagaaccttttaccgtttacataggtagggggtctttgtggggcaatccttacactgtaaaagattacggacgggacgagtgcataaaaatgtacagggagtacataatacagaaactagaaaaggacccgctgctcagaaaagagcttgctagtttaagggggcaggtcctgggttgttactgcaaaccccaggcttgtcatggtgatgtattagtagagttaatgcacagcgaagaatttaacagctactaaacgcacctgggcttagtcaaaacaacaacactattaactaatacggccccgcatggggccttagaggaagactatgaacatcatcaacattctcatcaaactcctgagtgcagcctacacagcagaagctaaacgagcagatgccaaagcgcaggttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctggggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgcagtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatatactgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctgcgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctatccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgaagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgaacagtttgtgagcctatacgaagagcacgacctgcttggggatattactcgcgcagcagcagcagccggggcggacttgacggacctggatatgcccgaggtaggtactctggacatccggcaagtactggaatcgcctttcttcttctgctgataaatgaagttaccggagtaggaatgaagttaaaacacactagtaaaacttccgattacactctcaaggttctgtataagtctgacgacattacagacgcagtgaggcaactacacgaactgggccacggcattagtcggggcctagctccagagcagcactactggagagtactgggcagcatactgggtaaacagtatatactaggagtctatgactcccaaggcgacttagtcggtgctgtaagctactacccagaagctgtagaggactgtcattacgtagagcctgtgctgtatacagacttcttcgtattgaagccgggtaacagtaaggcggtacttgtgattatgcagggccttcgcgcaatagctaagagtatgcgggctgggcgtatcgccattagccgaggtgcatcggataacacatacaatacaacttatcatttagtgaggtcagaatgagtggtggtttaggtaaactgttaggcaaggccacggatatgctcggccttactgacaacgcaggattagaggcgcagcagcgcttggcagagcaacaggccagcgcagctaaacaacaggctgccttagaggctaatagcgccgcagataacattgctgagattgaccccgcaggggctgcctctgcatctgcagaggcaattacgtctgagcagaagaaacggcgacaagcagggcagagcaatcctctgggcctgtaagggggtagcttggaacaaaaagcaacattagcagaactctttaagaaggaccaggacgcgggtgtcttggatgcctctgagaagtttgcgcagtggacgctcagcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgcctcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacagaggcatagatggataacgtagaaaacggtcagaacgtagaaactacacaggtagagaaccaaggtggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcaccccggttcgtaacgataagatgattatcgtggtggatacggtgctgtatatccgtaacccgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgcatctgggacgatacgcgcgagttcagcaacgtactggactgctacgcgatgtacaacataggtctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgcggaagagtaatacgcgcccctggtgccttcgggtgccaggggctttttttttgtccctgtcttaaaggtccaaggggtctttaatagaggaacaaatatgagagaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgtggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgctaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacggggtattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttcgatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcatacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgcgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggtagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagagttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtctttggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggagtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattataagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcagtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggcccagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccaagaaccgaatccacaggaaaaggattctgctaagggcgcaacacttaaacctgcgcctgagcgcgtagattggaacgatgccggagacaacggcctaaatgcactggaacgtgcctcattactggcgcaggccaagaccccagccactacagccggggagagctttgcatcaggtatgggcaacagtatcatcgctgcggctatccgtaaggcctctgccccggcatttgaccgggaccagaactttaacgccaagcagactctgagcagcgacaccagagctaagctgtatgctccaaatcaggaagagattgagtacttgcacgactcggtgtcggtagaggattacaactaccgcatgcagcaaatgcttgagcaacgcgaccgtgaccgcttaatggctgacaacacagtagctgggttcgcgggcatgctggtaggcgactccccgttcatcctggctccgatgtctgctgctggtattgctggtcgtgcgggcttagctgcacgtaccgctatccgcgccgctgacgtagggtccgcattctacgcacaggaccaactggggcagtctgctgcggtaactgcactggtagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatccaagtatcgagaaacaataccgcctccgtgaacatgaaagcacagcacgtagttcagttcttgaagaagtctgagcacttgacagcaggacagaaggctattctggacacgctgggcgatgctgtaaatgacattgattttaaactagtagcaggctccgcaaaccgcagccgctacacttatgcacaacaagatttagctaagcggggagagatatccctgcgcgcgcctaagcaagctaacggcagcacctggactacagtcggtgatgcgctgcgcgctatggatgcagatacaagcaaggtggccgtgcacgaactgattcatgccgctactgcgcgcgctattgacagtaatcccgagattgctaaacgcctggaggaagtgcgcgctgttattgcggctgattccaccctgacaccgcgtatgcgatattacgcaagtaatgtgcacgagatgctggcaggcttaggcgacagccctgagtgggttgagcatctggcgcggacgaaatccccaaccggtaagagcatgctccgccaactgggcgagtacatcatgaacgccctgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccagatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcaggggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcaaatccggtagcacatcccctgcgcggaatctgcgtcagcgtactcggttcaacatggacaaagagtatctggtgaacggtaagagcatgcgcatgcaggacctgatggatactgatgtagccaaggttatgcacgggtacactaaccgtatgtctgggcgtgtaggcatggcctatgcaggcgtacaggacctgggacagctcgctaagatgattgatgagtctaagcacgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcaagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaatgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacgggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacagtggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaaagtctgccgacgctatcctggatacccgagtaactaatctagagcagacctttatatccgacagggtcactgtaagctacccttggtttacagtactggatacccccacagacaccgtgacgccgcccatcgcttttagtaaggccatagttgagctgaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggcctcagtaggcgaactggcgtacaagggcccggcaaacgctgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacgttgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccctactcgtggggaccgtacttcattcgaaggctatgatgtcaactgcgacctgaaaccgctggataaatccgccagcgtagcctgtgtaggtatcactgcatccctgcaggggaagcgcgcggacctg

SEQ ID NO: 163 - DNA, 43499 bp, Unknown
  source: /note="Description of Unknown: MCoc8a Bacteriophage Sequence"
gtgtcgcaccacgtaactaccgcgtataagtcctgtgtaatccgctttttggataacccctgtatagtctacttgcataaaccctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcataagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcatcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagtggcgggaacagcatgttgtaaccttcgagtgaaagttgcatagtgcctacaatagcgcagtcgttctcgcacccaaggatacgcagctcctgccatttcgcctcaaggttctggtgctcactctccatagtgccgccacggatattcgccaccatgtcgatgatgattaccgcggggcgcatctcctccatgagcgtggatatctgcgccatcgtcaatgagtgcgcagccttgacacgaatccggtcagccctgcctactttcttgaggtaggctggcacgaactcttgcttactgtgccggtccttaatctccgccagagtccaatgcagcgccgcttgatataccctcggcactgtgcgcgtcgctgggccctcgttaaccaaccagaggatagggcggtccccgtacacttccggctgctgctgcatttgctcagcaaaatccacagcaatagcagcaagcagactagttttaccagagtccacaggagcagccactgcgatacagtccccgccacgtagacctcggatgttgctagcgagttgctcgaacacgcccagtttaagaccgccgctctcatcagtcgcggcaagtatctcgtcaacactaccactctcccattcaagcagcgaatcatgcaccgcagcgccatcaccgtacttgcgctgcaggtgcttcatctccaggaggtaatcaatctcctcaccgtcttggtagcgctgcgtaagcgccgctacctccccgctgtaggccagctcattcagggtttggacaatccccaccacagaatcctgcggcacggcttgtactccccgcataagctcgtccatgattacccgctcttcccgggataagtgccccgcccggaggttgagcatgctctgcatcgcatcccactgcacctcctggtgctctgggtacgtgttccagtacaaccccacccagtccagaaggttcgaagtgtccggcgcaagcatcgacttaggaatctgctctcgcaagcgagtccacactttctgcgtgcacatcgcacgaacaactataaggtccaattcttacctccttcaagcgcctcttgtaccagtctagctattactgcccgaagctgttgtgtcccatgatagcgcaccgccgcgtcccttagtttgttaactagctccctctggatatgtggttgcattgtatagcctccagaatctctttaatttctgcgtccttcgggtccgcagcgaagtaatgctcccggcactgcatgaacgggcgcaatgctcggcgtgctgccgctaccccagcgtgcccagccgggtcattgtccagcatcagaaccacttccgggcgattctgaatcagccaagccctcagcggcgtgggcaagcgtgtacccagcatagctatagcctgcacgttcaacgcactgtagctcgtaactgcgtgctgtatcttccgggctgatagatagtcctcggtgagcacgacctttagaggcgcggccgcagctacagccggtgctacggcaggtgccgcggcagcgaacggtaccggatggccgtacattacccacttcggttgttgtcgggcatgcactgcacggcccagagcagcgcttccgacacggaagattatccgctgtttctctttgctccattctgcatcctccaccatttcaggcatgattccctttgtggtcaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacctgcttacagcggtggcaataatattcccatgcatccgggttattgtagagcaccccggcggcgtccctgccgcagcaccgaaagcgcgccctctgccccacggccaggcgcttgcacgctctaagccagggctggtccattacttctgctcgcgcttaaccgacatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccaccttgtccgggactggcggcagctcatccttcgggtcttgatacagctcgaagttataggcgtaccacgggtaggggtcggctcccccatctgtaaagttatccaactgcagccagtggccgcttgtagttatatctgtaattacgtagtaagcaaaatcccctaggtacgacttgaacgacgaagtgtttttgtgtgctttgcgaacaactttatcaccaactttaaacttagacataatcaaccctccacaatattatcgtatccgccccagtcttctacgactcgggtgcctagttcaatcagctcttctttaaagccgtaatcggagaacaccattatgtactccgccgccttctctggattctcctgcacccagctaaccagttgttgtttagaaagctgcgacactacgcggaacgcagccagcaattgcgggtcctcgtccggtggcaggtcccacggctgccgtaaactgagcgtagatgcagagagccactggtccggctccactaccttcgggtcacgctcaatcggtaggcgcttgaacgtaccatcttgcagtacccgctcaagcacttgcccaagtatgttcaggtccagtacctcatccggggtgtgctcgtgcatgtaccctacaccgacgttggtgcactcaggaatgatgccaacgaactcggctgagtcagtatacacacccttctgcaagtgctgctccgtgcgtcccaggcgctctgctagggtcttggcaaaggtgtcagagcagcagcgcatatacctttgatgcgtaatgataccgtcgccgcggcggtcgaagctaatcatcgccttgaccccagtccaaaatccagagtcatccttgaccgatgcagcgctaccctcgcagcccacctcttcatccacgaagaagcagtaacgtccgtgcacaccccgccgcagcatctccagcatcagatagataccggcaccacagtcagcacccaagcagtcagcttgctgcggattctttacgaacagtacgcccttgttagtacaaccaacgtccggcgcagcgctggttggacgggccaccgtatcgaggtgcgacgtaaacgctacgtcgctttgctctgagtcccccaccagcacgaagtagttcccgtgcttgtcctttacgtagtgcataccactacccagcgcttgcataagcagcggctcaaaccactcagtgcttgcccagctaggccggtgcgttcgcagtatctgcaagagcagctgcatatcaatcccgtgcggattcaagaacattaagctgcctcctctacttcttcgtcatcgttgcccaggtacttctctcccaagcaatcagctgcatgctcagtgagaattaacccgtgcactgggtgttcttctgcgtgctcaataagcacctgccggtcctgtgcaaacaccagctcttcttggtcatgcactaccccttctaccgaacagtgctcaatgtccgcgtcatatacataggcgtcgtggtaatcagaccaagtacagctccagcgattatgcagcccttctcggccaactgcgtatacaaagtccccatcttctacacagccgtcgcagaccatatcaccacctgcggtttcctgcatgtcatcgacggagaagcgcgctccgcagcagcagcaccgggcagactctgcgccaacgtaaatgtacccttctgattcctgcgcctcgtactcgtaggcgtcacggattacaaaggcatcatcctcatactcatctacgccgcactggctgctatctaggtatggcatcagcactgcgccgttgtaggttgggtgcggtatgcgcgccagcattaccccctcgagacattcagtgtttctggtgtacccatgcccccgcaggattgcatccgcagcgtttccgtaagcacggacgtactctttggtttcaggttttacgattgctcgtgcctgcacttcgaagtcgtccccgaacagctccccggtgtactggatgaataggcgcagcccgttatctggtagcccgtggctggttgtagcatacgcccgcacagggctgtgctcaaatgagtacccgctcatgcagctacttgggccattctcgtaggcgtcataccattcctgctcggtcttgcacaggtacgttgtaggctctacgttcatagccttgaggtcttcgatggcgtcgcggaagtcaaccccgttgccgtagtaattggcgagccacttacctacgcgcatctctacgcagcggtactcagtaaccgcagcgaaatccttgtgcatccgcggctgccccagcatcacgatgggctcgccgttgcggaaaccgaagcccaacggaacagcgaatctagacactacgaaaccgtgcagcttcatgagcagacccacggcgtgcacgtctctgatgtggctaccgtaatcgtagccagtgtataattggcgctgctgctcttctggcgcaagcataatgcgttcgaataactgcagggcttgcttgtgcaccttgtaaccggtgaatgcttctacgctagcaagtacacgctcaaccactacgtcgccatcctcatagaagtcgcggcgacgttcccagaacttgttgtcaatggtgactcgcgccggggcaagcagttcaaagaaagttcctgaacggcacaagtccacccgttgcaacggaccggcagccctgtacatggcacgatatttcggatgcagtgccccacctatagatacctctaagcctggggtgtttgcgctgactttgaggagacccataagcgcctgcagtgcgctctcggtgtgcgggtagtcatagcctcgcatttgcaagtcctcgaaaggggtccagtaatcaccacttgaatacattgacccccgcattggcagtgcgtttgcaccttccggtaatactactttccattcgataggtgctgtgttagtttcctgcattttcatttgctcctgaatagattctttgagttcgtcagtaataacgaggtcagcgtgcgtaccacgcagcgagttgttgctgcttgtaataagcccggactgcggcccgaaattgcgtaaaagctccacgatacccgtaccgccgtagagccgcaaccacatcgaactgaatgtgctcttgcaaccgccgcgcggcagactctgtatactcccggtaggttgtgagcacagtgccaaccccctcttttctaactcggagtagtcgacgttcaactggcacgatttgcttgagttcattaggaacctctttgaatgtctcccaagtgcagccgcacttgccctgcgtttccagcagacgccagcacagcagcgctgtttcgtctactgtgagcatacgctgtccttgaacaccacgttgcgggctacgatggcgctgcggtcgctagatattaacccaccaaccttgtgcccggatggtatccaccgctgcaaatgctttgcatagaactccgcgcgcttatgcagtgggctgcgcagcggcacccggtacagcagcccattcgggcgcttgtatacgtcgtacaggttctgtttgctcatacaataccccttacattaaaccggtagcagtagcctcgcaaggtcatacccaggcgctgcgcttgcttctcgtagtgctggcgcagcgctgccttcgcgctgtactctcgcgccagtccttcgattgttggttgctgcctacacatcagcagcgtctcaggattctttccgtgcataccctacctcaaatatcgttgttgctcttaccgtccaccgtgagcgttacagcggcgtccgggtactgctcctgcaccgccgcaaggatacgcgcgcccagctctttgcaaccaccctcggggtcttcaaagaggtcatactcagggcgcggctgcggttgctgcgccgccggttgctgcaactgcactgtgcaatagggcaccgggttgtttacgtcgttgcccagcaccagcatagcgctggtcacaatgatgttgaacacgttaaccataaagttgtctccagtcgttgataatgccaagattcacggcgtccagcacagtgcgggcagccatttcggtgtaggtatccacaaattctaaaggggattcctgattagtgtctttgtcagagaatataaccacagtgtagctgtattcttcgtatatccgattgcaccacacgggccagagttcatggcccggatagaccagtattgctttcatatgaaacctcatacgccagttgcattcacatagcgccccgtaggacgctataggcttgctactaggccacttccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggccctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattacttcacatagcaccccataggatgctataggctgtaattagtgcccaaattgggagttaacagtaggccacccactaggctgtttactgccgcccttttgtttttgctttcccctcaccctgtgctcaccgctcaacccttgtttgctgggcttcacagtaagcggcacgttatcggtagggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcgaaccagcttactgcttgctatctaagttactcagtgaatcagaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactgcttggactcaatctagcttatgcccttcgcggtgtcaactctttttatcgagtgtctaacccttcgcactatctagctttaatccagcggagcctcccggctcggccccggttagcacctcagcgcctcccggtgattgaactatagacccattgaaccaaaagaagcaagcacttttttaagctttttatcaccgggagcaaaaagggtaagcagggtaaatacttagaaccacatcagggatagccctatgctggcactagctgtagccactgctagccattacgagccaatactacctaatactacaaagagcagaacgcagtggcgtaacgagagtgaagccacgtagtgatgcggtgactgtgtaggtatgtcagcctactgcgtaggcacagggacatactagggagtgcatagtgagtagtagtgtatatagtgtccctaaacccctcctactccggttacttcatttcataatagctttcgaatgaaagtaagagcaaagggatagcattgggagagcgctggatagtggaagtgcgccctagtggggagcgcgcagcgtagcatataatcagcacaatgtaaagcactagcgatagccagtggatagcctagtgcgtactagggatagcaccggggatagcactacagcgcactagctggcccactacggcggcactactggtcccactaggcaggcactaggcaggcccgcaatggacgcacaaaataagcaaggcatggcgcacccctatggcccacagggagcgcacagggatagccccagcgccccgtagagcgcacaggaagcgccctagtgaacgcacagggatagccatagggtagcactagcgatagccctagaacgcagcacaggcccgctgaggcccgctggtgcgcactagcaggccctagcagtgccccccccccctaaattgacgctaggcaccccctatgggggcaattgggcgcgttgagggtgagggaggggctcgcgtgagtctaataaatttcaggtccaggtatagacctgctcgcctagactgggcctgggttttacgctgtgcattagaagtgcaacaccaagctagcccgagtagccccaggggtaattggagtagccccaggattaaacagagtaactttgtaggagctgtacccgctgtagctactgataccggctagcagcccatcaacagacccgttaaataccggagaactcaaaccgacaggggcttgagtaatgccgtacggcagggtttgcacaggactagataccagcgtaccagcagcgacagcacctggggtccacgcaaagctaaatggaacagaacgagcacgctctactgtaataccatccaggctcagtgtgtttccggtgctgttggtgaagcgcaaatctccgtccccagttaggctgttacccaagtaaaagtctacatcgaaccaccctggaccagccggtaccgcagcaacagaggagccgccactacccactgctaaggttatgttaccagtagcgccgggattgtagactcgcaaggatacgcgcactatagccccgagaaggtgcagtggcaactggtaccgacgcatctcctggcccgcagggacatctagtgccacggtactagcggctccagccctaacggtacgactagcagcagcagccccgcgcatgtacgcctgcccgataaacccagggccgaacggactatccccgcgcactacgttcatgttcccactgtatacgcgaggagggttgatgcggcaagccctagtactactcagtgaccaggatagaacactgctggcatctgcaatgttcgcatcattgtcgaaggcatctacataaccaccttcaatggtccagaattctccttcgcacccatacgccttgttatcagaaataacaataggaccaacagctccagacctaatacgaatacacccggcatacaggttatggtcggagtctgggcggaagtgcgcaaaaccgttacgggtaatccaagagcgtgacagctgtccaaagtctagtacgtgctgcgtggttgtgttagctccgtacggtacactatcccactcaaacttattatccgtaatccacaccaggtccgggttactgtttgctgtactcttaatccacgcaccagagcacaacccgaatgtgttattctgaatgtgcaggttattgacgttattattaggaatacctatgtaatccccgaggagtataacgctgccgttagaggcacccatcctacggaataagtttccggagatgtgactctccatacagtcacgcaacaccagcgcagagcccgccaagttattaaaagcagagttttccgccccaaaatagctccaggacgttacctccaccataagtcccgaatcactgctgacagccccctgcagtcgcattctaaggaacccgccgcccattccacgggtgctcgtaccgtcaaagtagaacatcttactggctgtgctcggtttaacgaatacagccccaagcgggttaacgccctctaggccatcacctataaacagcatagggttagtaaggtggcagtctccaacataataagaccccacaggtactcgcagcacctttacacctttagcggaaatccgctcaatagcggctgcatagttaccagaagaatccggacggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacattcttgtactggttcccaatggctttgctctgccactgcctgcgctcccataggccccagcacactttattgcgctgcccattaatatactgggagcagtcgaaggtccagcggttgctgcccttgtacacccaaccggtgccgggggatttctgctggtatttgctaatatagcgccagtccagtacggccttccctgctgctgcataatccaggctcttgagatgccgcttcacggcgctaccgttgaagccagctacgcctacattataaatgaagtctacagacccaaccagggctacgtcagagagctgcataggaagcccgtcaagagcctttgcgtgttcccctgctgattgtattagctgcttctgacaatcgctcagcgtggctctctggcccattttaacgccctttgtctcgccatagcatatagtggggacacctgcgctatccttgtaggtggtaaggctcagaccctcgttgtgctgcactacgccggtaatggcgcctccgagcatagtggcccccgtgagggccgcaataaccttagtccttaaactcatatttaatagtccccttacgtgcctgctcctctaggagcttgaatgtacgccgcttgtaatacgcattccacgccagggttagcaccgcgcacaccgtcgcagtgatgaagctgatagtgctccagttccagctcattaactctgccaaccaacctcctgataccgtagcgccagtaactgctgcgcctgcccgggtagcgaggtccggcccaaccatgtcccctaccttaatcatcctgctgccccttcttcctgaatagcttacgaatcaccagaatgaccactaggaagaccagaggaatgctggccccagctaatccggcgaggataagactgtaactatcattgttaactacctgtaagcgttctgcctggattgtccccgtgctaatagtttgcacctgcttcttgctggacgtatccaaagtgcctacgttagaatctgatacatcggttttgttggtggtgctggagtccaccttgttgttcaggccaacggtttgcttggtgttttcggcaccaacctgagcagatacatccggcttagaaccaactaagccggtgagtgcagaggtcgccgagcaaccagtcaaagtaaccgcgagcagtaacccagcgaccagtttacgcattagcttgccgccttcactgcggctaccgcggcttcaagtgcagcaatcttggtatcgaaggcagcaccggtctgggccacgttctgcggctgcgtaaggatagcatataggtccttaccgagaatgttcagctggcgcagcagctcctgctgttgcgctggggttgcttttgcaattgccatgtgtactctcctttggtttattattcagcttctgccgctactgtagcagcctcaaatgcagattgcagggcggtgaatgaggtatcaaagtcggtacctgaaccctcacccaatggcataccagtgccagtcagcgcaacgtagccggtcttgctcagctgcgacagcatactgaatagacgagcctgtagcgtgccgtcagcaacgaagctagcgccttccgcggtggcggtatagccctgaccctccatatacgtaaagaacgtattcagagtgtctagggccgcggtgccgacaaagcccacgttgtagtctggagatacttgcttctccagattctgggccttacccacaatctcatactgtacatccacagctttagctgcgatgattgatgccattatcttcttcctctatgttgtttacctctgccgcggttctgcagccgagcagctacaccccgaaggcccttagacactttgctctgtgcccaatccagcgggttctcaatgaaggcccgagccatcttctcggactcacgctcagccaccactttctcatcttccaccagatgcccgttcagcgtagccaccatcatggctattgcgtctgcccggtcatctttagccaggctaccgcggtcgtacgtgatgccggacagctgcgcgaacgcagagtacagccaacgcctatcccgggggtacgccatacaagtgctgatatcatcgtgaatagcacgctcatgcactaccaggcggtggcggcgagtaactgggctgattgtgtcgatgatacgacgctctttctgcgtggagttgttcaggtcccgtacaccaataccggcgagacgccgctcccgtaaccggttcaggataagcatagacacggtaccgtgccccatgttgctctccaccaccatatccgggatgtctaactctacgcacaggtcaatcagtttatcaatgttctcttcgctgatacctccttggaagccgcctacggagaataggtgaatgtacgagttcgcagcaccaccagcagcgtaggacacttcatctccgccacaaccggccgggtccaccaccagcaccttatgctggtacggcaggtgcatgtccccatagaatgccgggaagtacatctgctgacccataatcccctcatgctcgtgctggtacaggtaccggcggtccgcgatgtaggagaacgtctccggggaggaatcctggctgccagagtaaaccagcatatccgaaagcttgatgcgcgtacgcatctggtcggacagtgtggtgtcgagcatatactgcagctggaagccttccggaccaaagtccagctccttctcaatcagcgcatcctcgtcatagcgtccggtgtccgtgctctcgcctagcgtcccgtcgacgccgaagccggtgcgtttatagccgcgctcaataagctccaggatataaggagcaagtgtacttccatatcgctcttccatttcaacagacggaatgcgccccggccacacgcggacctcgaagccacgtcccggcagggttttgtagatactgtccttggtctgcggtgtacccaggtacagcgtatccccgtgcgtacagatagctgcgaagtctttagaaatcatcagcagctgctcacgctgggtttgcgttaagccgttcttagtggtctcgatatcgtctggaatcaacaggtccgcacgtttaccctgcaaggatgcggttatacctacacaggctacgctggcggacttatccagaggtttcaggtcgcagttaacatcgtaaccttcgaatgaagtacggtccccacgagtagggtcagccttcaagtagcacagcagcggccaggtttccagcatacgaatgattaagttagctacatcggacgcctgcttctccgcgccggacacaatcaggatacggcaggattggtcctggataagcctccagacggcgtagagtgctgccagtgtagacttagcctcaccacgctgcgcagccaccatgcgcttcctagggcccttctgcatgtactctgcaatgtcggcctgcatgtccgtgagcgtaaagcccaggaaccgcataccgatgtacgcaaattcccggaagtcactcagcgccgcggccatcatcatcgcgatgtcctcgcgctcctctttgggaatactgcgcggattcgcgctataaccagtaagtttctggttgagcatgcgcagtcttcgcgcagtcttcaccgataccattagacaattccttctagtaagtcctcagaatctgaaccactaatcttgtttaaaatctctttcttacgcgcctctctgcgcgccgctagttcgtcatcgaactcgtcgcgaaggtcctgcatctcctcggaatctgcatccgcggtgatgtcattgtccttcaagaacttagcgataactgacttatctgcggcggggagcggcacctcatcttccttagactgcttgatttcttcaatcaaggcctcagtgaacatgcggtgcagctctgagaggcgactacgtttagccgcccctgccatactttctcctgttacgttcctagcaccccactagtgcgtagtgctgccagcagcgcatttagttgagccactacgtctccagtacctgttgcatcagatacagccgtggctttatccagatacgccaaattccccaaggagtcggccaagtaatctacggatgcttgtgtagcgaatccgtcccccgcagttacgtcgacccccagtcgggcggctacaatagttcctgcaggtaatgtctctgcaaagagtatcgtattatctacaatctcgaaactgtaaccgcgaatctgcccaaccccgttaatctccactacagccttggtgaatgctaggccaggagtcacttcgtccgtatcctcggtcagcaccgtgctccacgggtagctaactgtctctaccccgcttataaaggtgttctccaaagcggaagtacgggcgctcagtgcgtcgtccactgccttccggatagccgcctctgtctgcacggcggatacccaggctgagtgttctgagtcaatgcgcgcgtcaagcctagcatcaccaacatctacatagttcttggtcgcggcatcctgagggcctgtcgggtccgctatgttagtaatgcgatacccattcatgcttatatccccgtagaatccggggatagccctgccctctaccagctcttgagccaggtgcaagaactgggtattttgagaatctacgtttacctcgatgaacggagagccgcttgcgaactcgatgtacagatactctcgctctgtcttacggattagcagcacagtcgtgcttgctgccaaggctgtatttagtctgatattagtggagctggtccaagtgtatccagtggtttcaacgccgtcgagatatacatgaatataggacttgtccaaatactcaatatcacactggatatcctgggtaccagctggcttgatttgctcttgccagctgaatgccatattaatcgtctccgaagttattgattatagctcgcgtaggtgcgaattcctggattaacgggacctgcttagtgaaggtcttgatatccatattaccggtagccaggtcctgcaccgctccaagcagccctgtgacgtaacccatagatgctaatgagtgacgaggagaatctcccaggaagatatcctgcagtaaggatatcccgccgatggcactcatacccattacggactcgccgatgagtttctgggtgtccacgtccttcccgtccatgccatgcttagccatagtagccagcagcattaacgggaactggtacgccataatgtgggctacgccaatccacccagcatcgttcagctctctacgcagaatcttgttagtggcagccagtgcgaagctctggtaccctacaatgactttgccaatagggttgaactgtgcaaagtgtgaggtctctccagtacgaacctgctgtaccaggtagtccatcatacgcgtccctacaacctcaacttgtatctgcaggtccggctggaacatggcgcccgggttagccttgttggcagcgatagcacggtctgcaatttcgcgggtaagcccgaaacgctccagacgcttaaacgcctcagcatcgcccttgaacatctgcgtaagctcgtctgccacgataccggagttcaggttaacctgcagccggtgcaccatactcatgccgttgacgtgacgtgcagcctgcccaacgttctgagtgacgttgaaccaggaggcctgacgggtcaggtccaggttatcgtcagcgtacgtattcagccagcggaagcgcatctccttctggatattacctcgcagcacggtgtctagacgagaagccatatctggggtcttgatagctacggcaccttccttgaaccaaggctggtctcgcatactgcgcagcaccctagccatgccgaactccttcatagccaaagcagtatcagtcaactgatacagcccggagttcttgagcatggtggcgttagccatgttcccggctgcacgcagcaaatccggaagctgtccagcgtcagcgggtgctccgcccaggataaagtcgatggtgtcgttgacggtcttctcccacttagcggagtccgccagtgcatgcttagactcatcaatcatcttagctagctggcccaggtcctgtacgcctgcataggccatacccacacgtccagacatacggttagtgtacccgtgcataaccttggctacatcagtatccatcaggtcctgcatgcgcatgctctttccgttaatcaggtactctttgtccatgttgaaccgagtacgctgacgcaggttccgcgcaggagatgtgctgcctgattctcgtacgttaccagccaggaagctctggattgcagactcttctacaccagcgctgcgcatagccatgacgacctcatcgttacccatgccgttaatcagctgcttccacatagggccagactgtcccgcacggccgttgtagataccgtcaaccatctccttggcaacacgctgcactacctctgactccatgctagggtacacgtcccgcagggcggcccggaacagggctcggtagtcgtccagagtgttaccctgtgcgataccttgacgcatcttgtcatagctgtactggcgcgggaagtagtagtcggatttaaccaacgcaccatcatccactagaccggcattgagcatatgctcgtgccacttgctagcccagccagagcgacggtaggcatcaaccaacggagcaatctctgcatccggcaccggaacagcgcgaccgtttacgtcggcgctataagcggcatccaggtacttgctcaggcggtcttccagcgcagcccgctcagcgcggaaattactacgatggaagaagcgtgagagtacgcctacacccttatccctcaatgcgcccagtatagcatcttccactacgctggcacgagcatccatctccaaagtgaggttacgcttgtagtctaccactgacgggcgacggccgcctactgcagacgcatccgacactagcagtttagccaagtcttcgttgccttgggcgatattatcgtacagtgcaaacatagtggagagcttcttcttagcgccgtctagcatagcttgggcgcgcttagcctcgttgagggtggtgctatccgccaggtcctggaaggcttcgctacggaagctctgggcttggtctgcataatccttagcggtccacttaacggcgtcctcgtatgcatccaggacatcctccaaggcagagcctttggccttgatgcccagagcgttcatgatgtactcacccagttggcggagcatgctcttaccggtgggagactgcgtacgtgccaggtgctcaacccactcagggctgtcacctaagcctgccagcatctcgtgcacactactagcgtaatatcgcatacgcggtgtcaaagtggagtcagctgcaataacagcgcgcacttcctccaggcgtttagcaatctcgggattactgtcaatggcgcgcgcagtagcggcatgaatcagttcgtgcacggccaccttgcttgtatctgcatccatagcgcgcagcgcatcaccgactgtagtccaggtgctgccgttagcttgcttaggcgcgcgcagggatatctccccacgcttagctaaatcttgttgtgcgtaagtgtagcggctacggtttgcggagcctgctaccagtttaaaatcaatgtcatttacagcatcgcccaacgtgtccagaatagccttctgtcctgctgtcaagtgctcagacttcttcaagaactgaactacgtgctgtgctttcatgttcacggaggcggtattgtttctagatacttggatgctttcatccagtgtcttagtgaggatttcctctccctctcctactccggtaacattagcatccctagctgtacgcgttgtaggcgcttctgggtcgaacataggctcatgcccagtacgcgccttagcggcagctttagcagccctagacatatcccagagctggtctaacccagctacgcccgctatcagtgcagttaccgcggcggactggcccagttggtcctgtgcatagaatgcagaccctacgtcagcagcacggatagcagtacgtgcagctaagcccgcacggccagcaataccagcagcagacatcggggctaggataaacggggagtcacctaccagcatacctgcgaacccagccactgtgttgtctgccattaagcggtcacggtcacgctgctcaagcatctgctgcatgcggtagttgtaatcttctaccgacacagagtcgtgcaggtactcaatctcttcctgattcggagcatacaatttagcccgagtatcgctactcagggtctgcttagcattaaagttcgggtctcggtcaaatgccggagcagaggccttacgtatagcggcggcaatgatgctgttacccatacccgatgcaaagctctctgcggctgtagtagctggtgtcttggcctgtgccagtaatgaggcacgctccagtgcgttcagaccgttgtccccggcatcgttccaatctacgcgctcaggcgcaggtttaagtgttgcgcccttagcagaatccttttcctgtggattcggttcttggttcagaaactgagccataatatctcctaaaagaattttgataaggggaggccccgaagggcctctagttagtgcgttgcttcaaagagccaatcgcgtaggttttgttccaggtacttcttacgctcaggttgggcctgcttgtacgccggggtattccgcagcgcttgccaagccctaccctgggcctcagatacagggtactgatacgcccccaccggggacttagcagccttgcgtacctgtgccatcgcctctgctacagggccggagctaccgttaccaccgtgatagttcaggtccaccattacctttaacgcctcgtcggaggcattcaaaccctgccccttgagttgcttctgcacgttcggtatgtactgcttctccatggaggacttgaggatactgatgccgtcatcaatggtcactttctgtgggacgggcatgcccgagttaacatgcagaccgaagcctacactacccttgcctttaccttctcggaacccttcgaacttcatagtggtggcgagaatgtcactaaacagtgatggttccagccccaccgagttacgaccgttgacttgcacgctgacagcacgtccgttgtcgtggtcatagaaggtagcgggacgtacgcctacttgttcgctgccaatcttcatctcgccagctagtgccgagtcatacgcagcctgtgcagtagcctgaacgtctcgaaggttcacagacatagtctggaatgcgcccttcttgtcgaacacggttacggtcatgttctgacctgcgttgcccgcggtggcggcctgcactactacacgctctatgttgctggggtctgacatatactgaacctggttctgtatatgctgctgcagggaggccttgaattgctcttggtcacccttataatcccccatgatagattgcacagaggtgccagcgggcagatacacatgcctaggtgccccagcaatgtccagctccagcttacgggattggatattgccttttagcatcgtattgatgtcgtcagcgtccttccctacaagggattccggattgtggttatacacataacggtactcgtcttccatagcagctcgcgcttcctggcgctgggcgtctgcatccccgaagaagctgaaccagttagccgtgccgcttgggtccaccatcttgtccgtggggttactttgaatattgctgtagcgcccactcgccttattcctagcctggcggcgaaggtcgtccaagatagtgttgctggcattatttgggttttgtgtaacagctttctgcaccactccacgccactcagatggaacctcagacagtagcgccatcttccctaagtccgtactggtgctataagcttgtgcccacaagttgatgctgttgacgttctcccgggaaacctcaccgtcctcaccgagctggtccagcgtagtcagcgtacgtgccatatccgaagacatacgcttgtgcgcttcgttgacggcccacgcatccttgctgttgcttccgtatgccagcagctgcaagttcccttctggagtgtctgggaaattcttgagtaactgcgtacgtgccttatctaagtcacccttgaacatccctgccagagtggagcttggcatattcccagtaattgctgtgcgcaatgcttgggcgtctgctgccttctctcgaatggtctgagccttgttccagaactccatgctggtcccggcgctaagtacatcagatgccgacagctcaatgacacgactacgaatacgctgcatagtctgttcctgctgctctggggtctgaccttcgagagactggattgcatcggagatttcgaaacgagcttgggtctcaatctgagcaccggcgcgcttgaactcctgatacagcgccgcgtttacatccacggagttgacgccgagttccttggtggccatttcctgcagctggttgattgccagcgggtcctgcgtctgctgcgctacgctaaccagatactgcttggctcggtccagcttcttgttcttgtccaagtgctcagcagccaggatactgtctaatccggtcttgatagacatctgcgcagcggcaccctgtcctgcctgcaggcgctgatagaactcatcactggacgcactcagcccacggtcgagggcacggtcagcctgggccagggcgaacgcagcacgtcctttctggaaggctgtatagttagccatactggtagcgcggagctgctgcagtatactcgtagcagactgcttggacatatccgggagatacatcccgagcttgtctgacattgactgtacgtgctcttgctcctgctgctggaattcctcgtcagtcagccctgcctcggcagctttcttagcccgggcgatgctgtctgtgcgccacttggctagagtgtcgtacgctgcggcggatacgtagccgtcctggtaggcttcgcgcacgaagatgttttgcttctgtacagcctcgtccttggaggccattgcatctactgcgccctgagcatccatagcgccgcgcacggtggcggctgcggcgttttcttttactgcctcgtcgaaacctacgccgaagtcctgcacgaaccctgacagggcggctaggcgttttgctttggaggtatcaacagatacttcacttaccgttgacggtaagctaacatcgttggactgcagttgcactcctccgatatttaacccctgtctaccgggttgaatcacaggcatttagtattcctcctaatttaccaggtgtgaactgggctattgcccttactcccccataagtcataggaggatgccatgctctgcgtagctgacgctccgctaccaggcgaagagctgccagagtcagaagatgacgcagcgttaccggcgtactgcccaacagcggatgccccgacactcaacagcgagttaaacatattatcgtacgggtcctccatatccatgttagccaggccgctatccacagccttatctgtcattagacggaagccctcttcctgagttgcctgctggtcgcgcacactggcctcttgccgcccggctacagtgttcactgtggctacagcgtctttaaccgaggcccccatagtcccagaggctgcagcctgtagtcctacttggctctgtgcctgcagcttctgctgctgaatgttaaacagagacacctcagtccggtccctggactgggcgcgctgtagcgcgatgtcgtttagctgtttggctgtctgttgaatcacagccttgttcctggccttggacacttcaatctgagcaccctgccccagaacggtcttagcggccatggccgcaaccatccaccacatattaaatcctccgtctgcgttggttgtagcgcaggatgtacgatatatccaacacgttcagttccatagaaccgtcagtaaatagtgacacctcggttgtgtctgcgttggtacgacatggcacggtaatcgtagccaggtccatacgcagagcctgcccaagcgtcagctcctttgagttcatcaggataccagtcagttccccgccccaattgacgtcccgcggggtgtctagtacctgtacatcgaagtgcccagagttacgcaccgctacatccagacgcagcaggcgcacatgcccacttccaacgagcttgtcattctggtcccgtagaataggcgtagttagcgtgaaagtactacggtaacgtctcccgattacataagtgccatcaggtacgccgcgcacaacccgtagggtgttctccccggcaatctccttgatgccgacctcagtaggccccatagggttgccgggtaagtacgttaggataagctcttccttgtagttgtccgcccacccaaccgggcgcaataccgccggaacagtgaacacccctccctgtacttgaacttgcttctgcaaatccgagtaggcttcgcggtactctgaacccaactgataaccttcacgcgggtccatagacacaatcaggagcttgttgctgggactgggcccttgcatgtacaagaacacctcgtcctccagcgcctgtacgctcaggattgggtacgggaacgaccacttatgccacgctgcctgcatcttagcgccgtcacttccgccccacatgaactcgtagaccagcaggctattacgctctccagacatgcgcgagaaggccatattggtgacactggagttttgcatctgcaataccctgcctgggatataccgaggtaggtgcaccgtggcatcctgcgtagtgtactgcgcagcggtgtacggcgacgggattagctccaatatacccgcgtagctgtcgttgcgcttgttcgggtagattactgtctgacccgccattaccggggtaacacggctgtcacaatcataggtgctggtaatgctaatgcttgcgttggtgggcgtaagcactgcagagcccggtacaacggcctgcatgctgttagcaaacaggaccaagtcccggttgaactgcacagcggtgcggtacacagaatcctgggcagacgcagagctaatgctgatacggtccgtatccagcagtgacgtcacagtagagcggtagaagcgctgatacagaccagaggctgacatatccacagagctgccgctaagcagaaccaggcggccctggaaagctgcaattccggtgatgtagccgttctctacgaaccccgggtcgctgttgttgtcgtcgttgccagctaaacgtccctcccaatcccgcgcgatgatgttgtcatccgcggcgagctctctaggcatgttcgtaatcttagtgatgctaccatacgcccccacctcagaccaggtgcgggtgctgtagctgaactggtaccatgctgtctcagacgaggcggtacccacacgacacattgctccgtcagcttgcgctgggagctgtgcaggcaggtcctgctcctggtctacacgagactggttggacaccacagcgtaagtatcacccgcgtcagaggataccacacagttgcttaacccatagaagaacaggtacgcgccacgtacgctcacgttcccagctggcaacccattcgctacaagagagtcacgcagttgctgagcaacgtaagcaccagatacctcctcagcgttaccgctggtactaccagcagctggggcggtgtagtcccctgagtagtctacccctgcagaggtaacggtgacgttccagcgtttctggaatgctgcggatttaacgtagaagaacccggtggtactggggtcgatgcgcccagtattgtccacggttgtgttcggagccatctcagtattcaggatataagtcaatccagcaatacttgcggtctgcaaagaggtctggcctacggtggtaacaaagtacgggtcattgccggaattaaggatggtctttccattcttagccagcaaccaccagttaccgttgctggtgttaatcagcaggtgcctaccgtcagtcccacgctctacgtattcagtgaacagggagtcaagcccagggttatctatcgtgctttcccagacaatctcacccggcggtctacggcggataccggaaaccgggtcgctgagcatattcagctgcgcccccagttgcccgggctggcgctctcttggaacctgctgggagacgccctgcagtaggctctgaatggtaccttctaatgattgcgccataacctctccttaaaccataaaacgagcgcggcggattctgcgtgcaaagcgggtcttgctggtgctgaacttctgattgcgcagatgctcgcgcagcaccatgctcttgtaccgctcagcttcctgtgcgtaattagcgtagttgctgtcgccacccaggtcgtttaagtatacctgtgcagtggtgtagttagccacccacatagcggcgtgctccggtaggtcctcaaaggctaaatccaggaccacgcgaatacgtacaggcgtatcgaagtattggttctgctctaccaggtcgtacaggttcccgtcacgtaccccgtacttggagtctgagcaggcatcgtacacggccagctggttccacggcaccttaatcaggccgtcagtggtgggggtaacttcgcgctcgaccacgttaaaccagaaccccgtgctgagtaacccgcgacgattgcgtgcaagcgcagagcgagctaaccccgcactcgggttactggtgttgatgtccataacgcgagattcccccaaggcttccagcgtcaggttcacagcatctaattctctcatatttgttcctccattaaagaccccttggacccttaagacagggacaaaaaaaaagcccctggcacccgaaggcaccaggggcgcgtattactcttccgtagtatcagcggctacgtcagccgccttacgggttttcttggtagccttgcggccagattcaaccgaagccacctggatgttcttcgctacatcggtggcggccttaaccgcctcccgctgagctgcattagcctggagggtctccagaccgaacgtagcaattactgccattgaacctccaattaggacttggtggtgaaggtgaacttggtcactgcagcggtgtccggacgacgcaggccgatgttgtacatcgcgtagcagtccagtacgttgctgaactcgcgcgtatcgtcccagatacgggaggtgaacggcttagcttcaacagtcaccagggtcttggacttgctgaaagtcaccatacggcacagcgcgtcgtcagaggtgacggtgtaagcagagcccagcgggtgcgtaccagcagcggtcgggaactccgtgcactctactacaggcactccgttcatcttcactacacggcggtctttgtaaccgtcgttgttggatgcaccaaagtccaggttcaggagcttcggatgctccagcagacgcgaataggtatcgacatccaccagggtaatcatatccgccagcggggttttgcgcttgatgagttcatcaataccagccttgtgggccaggttaatgttcatggcgttcgcctccatctcagcctgggtcagctgcgtggaaggggtggcacccggaaccagaatagctgcgcctacctcgataccgtcgttgaacgccggtttcaggtgcgccggagcaacccaggagcggcccttgatgagctgaatcaggtgcgcctggtcgaaggtctctgcgaactcagagccgttgttctgacccatctcggtcaggaagtccggaccggtccagtcatcctggtagtcaatcgggttacggatatacagcaccgtatccaccacgataatcatcttatcgttacggaccggagtgctatccagcgcctcaccggagcgacgacctttcaccgaggaggtattcaggcggtcgatacggtaggtgttagagccactgatagagcgctggctggagaggcccaggaacagagcctggtactggaagcgggtatccacttcgttctgatacacttcaaggtgaatatctacgtcagacgccgctccgccccagtgcggacgagtcaggttgccattataaatagtgttggccatgctttagtttcctttataaataaaattaaagacctacgcgcttaccagcttcacggcgtgcgagcaaatcgttataacgttgactgaactgtggggacgccaagctacggttgcccgcttcctgacggagtttggtatattctgcgcggaattctgcagcagacagtgcattgttgctggccacgccccgtaccattgggttctgtgtcttgataagacccatatcccggcagaagcttgctaccaactcagcggcctgcttgagctcacccgagttagcgagtacacgagccgcgttacgaagaggttcaggggccttggaattaaacagctgcgctgctacctcccagttctccttaccgcccacgatatcgtaagcttcctgtactgctttggtggcttgaccaacctggtcttccaggtacgctttagccagcaactctgcataagcagcgtgctctccgaaacgttccttaatgaaggtcgtatcgattaggttagggtcctgatactccagggccttgccaagtgcccgcaccatatcagagtcagttaacccagagactttctgcaacatagctacaccggcgtcaatcgtcgggttgcctgtcttagccagctcctggggctgctctttagcgctatcgccacccttatccagggccgcttttagggcttcgatatccagaggaatcttagcagggtcaggggaatctttgccctgttgctgctgggtaggggtctgtgcatcctgcacgccttgattgttaggggcgttaaggggagcacctaggcccggaatcttagggccaccttggttctctacctgtgtagtttctacgttctgaccgttttctacgttatccatctatgcctcggttgttaacttggtaataagcccagctgcttacctgctactgtcgggtctgctgctgtcaagccctggagttggtcctgtgctagacctgcggacgtatcggcagacgcatcctgaacctgttgcttctgctgcagctgctcttcggtgtacatgaacggctcgctgacgataccataggcgtcgaagtaccagtctacgcacgcatccttgttgaagcgtggagtaatctgctccagcacagggatagccagctgcatggactgcgccgcctctaacagcttgtccgctgccgcggctttagctagtgcagaggtgccaacagtaacgttgatgctcactacgccttcgctgaggtacagcttaaagcgagggtacgccagcgcagtgtacaagtacgccagcttacgcagccaggtgtcgctcaggatactgaacccaccacccatagcggcttccgcctctttggcattctggcgaatctcgtaagccgtgacacgctcaccctgcctggagttaccagtgtacataaacgcacgcgatagtttctgttcgagcatctggatgttgctggcaatccactgaatcttctgggcagagccgccctcgtaagcagtgacgggggatttgctgttcccgttggaaccaccgccgcccacctgcacagcctcgcccgtctccgacgttgcgaactcatctacatccagaccggaacttgcgtcaaccagcgggattaaccgcgcagactcaacctcgtagttagttaatgcttccgatagtaccgacaaccgagcaaagtccccggcgtagtcctctaccaagccgcgtccgtagtgctcgccgctaacaaggttccacaccagcacgttgtatggaagttccagctccggataggtgctgctgtccccaatacggtgtccgtctgcttcttggtacacctcgtagcttactacctctacgccttcctctgtccgcttaaccttgcgacaagcggcagtgtagatatcaacgtcgccgtatgggtctttgtcacggtagaaggtgccgcggaaatcttctggcaggtcctggatgcttgcgcgctctctgataatgagtcgcaggacgttcccactgccatcccttcgaacggtaaagttacggactgagtagacgatggatttacctgtccgctcatcaatatactccaacgcgttacctgtaaccagcagcagcttcacagcttgcaacttcgcagcataaccgtctttctcaaatactttctgtgacgccgtgttctcgacctcagccagcttagattctgctgtagctgcactacccagcgaactaatgaactcgtccaggtccgaactcttggagaaccggaagaaactagtgccttgcgggaacagtgaccctacaatcttagtggctgcagtgttgaccagctgcgcgccggtgctctggtagtcacgctccagaggcctgcgtctaccgtccagggaatcgtcccgggtaaagatagtgctgagtgtccactgcgcgaacttctcagaggcatccaagacgcctgcgtcctggtccttcttaaagagttctgctaatgttgctttttgttccaagctacccccttacaggcccagaggattgctctgccctgcttgtcgtcgtttcttctgctcagacgtaattgcatctgcagatgcagaggcagcccctgcggggtcaatctccgcaatgttatctgcggcgctattagcctctagggcagcctgttgtttcgctgcgctagcctgctgctctgccaagcgctgctgcgcctctaatcctgcgttgtccgtaaggccgagcatatccgtggccttgcctaacagtttacctaaaccaccactcattctgacctcactaaatgataagttgtattgtatgtgttatccgatgcacctcggctaatggcgatacgcccagcccgcatactcttagctattgcgcgaaggccctgcataatcacaagtaccgccttactgttacctggcttcaatacgaagaagtctgtatacagcacaggctctacgtaatgacagtcctctacagcttctgggtagtagctgacagcaccgactaagtcgccttgggagtcatagactcctagtatatactgtttacccagtatgctgcccagtactctccagtagtgctgctctggagctaggccccgactaatgccgtggcccagttcgtgcagttgcctcactgcgtctgtaatgtcgtcagacttatacagaaccttgagagtgtaatcggaagttttactagtgtgttttaacttcattcctactccggtaacttcatttatcagcagaagaagaaaggcgattccagtacttgccggatgtccagagtacccacctcgggcatatccaggtccgtcaagtccgccccggctgctgctgctgcgcgagtaatatccccaagcaggtcattctcttcgtagagacgcacaaactgttcacggatgtgtcggtgcatagcatcaacgtcggctgcgtgagtagccagcgagtcgtgaataggtacaatatccaacccctccgcagcgcagagcaccatcatcaagtgcgtactatccaggctatgcacaaagtttggggcaatcccggaggccgccttacgcttgttgcatgtcttaaaatctcgattatgcactcgcatgacagtgagattcatacagtcaatacgtacacgcacttcttcacgctgtgtgtagcggttcattacaagcccacccagcggcgtataccactgcaggtgctggcttgccggtacacgtctagctaggttctgcaagtacgacataactgccgcagcagcagggtttgcctcctcgatagcggcgcgcatacgcggagccaggtagcacgacagattccatagactgttagtgtcggtaccttcatacccctcagcgcaagcgccttcaaagatgtagtcactgcagctgcgcaccgtggcgctgtagaagtaggtcatactggggcgcttggtcatgctgcgggtgatttcgttctctctccagtaagtgctctggataacgaaatcctccttgtccaggtccagtatcaccttctcgtccgtacggcgcttcacatccatatacaggtccgctttcttgtcattaccctcccagtacaggttcgtcagacgaccgcccacagggtctctcaggagcgctgagaggtgctgcccacctgagttcgtagcgtccatagccactgggattcggctaatatactcttctgggcacgcagaatcaagtgcagcaacaaggtctgtagccgctgccaacaagcaccacggcgagtcggccgacctaaaagcatccgaactaaatggattgtgtaccaactctcgtatttgaccaatatttgcatcaacccaatctgcacggtcttcgaatagggttttgtcataaccaaagcaattggcgatatgcaccttgagccagaacaggccacgctcccccagcggcttgcccctaccaaattcaaggagggctttctgcaaatcagaaccctggggatgcagagaggacttgaagtacaggcggtagcgccagtccgcacaagtcgggaagtacagggctttctcatctttgaattcctcagccatttccaacgtagtcagaaggctgcgcagttgcgatacacgcttacggtcggcgctataccatagagacatacgcgtcttccactcaccgaagcggtcaagctcttcctcagtgtaattctctttcggaaccccgtccagataccactccggtttcggctccggtactgagcgaggcatacctatcccaacacccagggcccgtgcttcttgcaccagttccagtacgcgcttattaatacggtacggggtttcctgtgccttattaagcgcttttttgatgccgtccgcggacttaaatgcttccgctacttcacggagacgagctctgtcaatgtgcgcgttatggtaggttccgcgattgtcgataggggtgaggtacccaccatcccacagagtagtgtgctgcaccggcggtatcagcataggcggcttcatggttacagtatcagcggactctaccagtttctggaaggcctccataacgtcatcagccggatagagcatgctcagattcccgctacagttcttccactggaacagtcccgtctcaaacactgcggcacacagcagacgccctacggagatgttctgggcattggtccaaggctcgtgcccgtagtgtacgttctcggcactggcacggagcgtacgcaggatgtgcgtaggggacttcgtacggcgctctgtgaggtactcatacacgcggtccatgtacgctggggctacgttgcgtaactgcagagccagtagctctgactgcacgttccggcccagcgcagacattaccgcctgtgcagtctggcggcgactagcggactcgcctggggcgacactgaacgcctcaaacattgtgcacaggctcagggtggtcaggacatccaagggtactaagcgcaggaaccggcggtacttaccaccgatgcccggggctttgacatttcgcatctcgtcgatagcggtagcagccacctcgtatgccgaggtgagcatacgctgcgtcatcggcaggttcataatcccaccgttctgcaacgcgtccgtaatcagcttacgcgcgcgctcgattccgcgaatcttataggtctcttcaagctccagctggcgtttcaccagtgcttcctctggtactacaaccgtattcagggcgctaatcataggcgcttagtctccttggttatgtccggtacttctaactactgatttcgacttacccagagattatacatctccaggtagtttttagcgccgcgttcgtcgcctcgctctactgctttctgccacatcatgtggcaccactcactcggccgcactatccatctgctccagttctagaataaataacgcacaacaagcggcgtgcgccaggtgcggcaacccactctccgagtccagtgtttcccctagagcgtgtgctgtgaggtgccgcagtagcgcggccttgtatcgggacttaccttcggctaccgtgtgccaactgtgtgccgcatacttctgggccccgaaggtcagcacatcactgatacgcagcaacgcattcgggcacccgtccagtagcaagtccattcgaggtttgcctgcgtcatacttcatgcctgtacctactgcactcatgctaattcctccaccccgtgggattttaagtctgttcgatgtgttgctgcaccatagtcgcatacagcgtaagtggtaatacccagtccgcggaaatgctcaatcaccgcggggctgtcgtcccaagccgccacaatgttttccagcccgacttggttacgcagaaattcctctttgatgacagtatcctttcggttgtcgctgtgcggcctcataaccagctcggagtacataacgaagttccgctcaagccaggcctctgtttccgctcttactatatccgagcgccccgtcaagataataacccgcaaccctgcccgcaccatgatgttgcacacttcaatagtgctgtggatagggctatcatacttcgaggcccggttgaactcattccaactgtcagtcagatacaaatccacagtaggcagcaagtgcaagcggtgcgcgccatcagctagtgtaccgtccaaatcaaagattactgtcttcatttaatagcccctccccgtgctttttgtcgcgccgctctactaccctctgccacatctcatgacaccatgcactaagcgtcaatgcacttacctcggtgttgctcatacagttctgggtacttatcggacttagcaatgtcctgctccagtgtatccttgttaccggcgcagagtctgtattttaatctgttaccgagacaatagccgtagaactgctcttgcgtcatgctgcgtgcaattacctctattgcctccaggtccgggaagaactggtagtgccgaggagagttcactgagtcagaaacagcctcgctcttcgaatggaagagctggaagaaccccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaacagtctcccgtgctttgcgtcgtgccctggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatacgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaagtgctcaaccgttcttcgatgtgttttgggtgctcgttcacgcagcgcatccagaatagtttcaagttcatcgtgtttcccatcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaatccatccgaatgggtcctccagtgcaggccacactgtacctgtcggtatatcgaaccgagccatagggctgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcctgcaggcgtcaggtacgccactgcctctgagcagccgaccaggaacatatcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcatatgcacggcgccgggacttggcgcactggcgattcaagtgataacgctgcgcactaatctcgggacccagaaggcttgccctgtatgcgtgagagttagctgcccagcgccagtcgtctgctcgcttctgcaaacgctgtgcgcgcagaagcagaaacacagcgtactgttctttggcccatgtgattatgcgcatttatacccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaaactgcgctttggcatctgctcgtttagcttctgctgtgtaggctgcactcaggagtttgataaggatgttgatgatgttcataggcttcctctaaggccccaggaggggccgtattagtttcgattagggtttattaggcttgaggtgcagcgggcgctgctggagctacaggcgctacaggagccgcaggagccactggagcagctggggctgccggcgcagcgggagccgccggtgcagaaggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgtaggctgtcccaggtctctttggttgggttgttccacaggaacagcttaatctcggaggcatccagcgctggcatcttaataggttcaccggtgttcgggtcgaacttaggaatcgggcggataccggacaggtccacgatgttcgacttcttacccgcggcgctggtgtgctcatcaatcgggaaggtgaaggcctggcccagacgctgcgctgcatgcttaatgctattgtcgtagttgagcttgtcgaagaacttcttgaagcctgctcgctcaaagttactgatagccatcgggtacgggcggatacgcttcacttcgccgttggggccgaacactacaatgccgatacgtacgttagccactgcaggcttaccggtaggcttaccacccttggtcggcaggcgcttaccgatttccacatactcggtgaagtaaccgtaatattcacccttcggcagcagcacgtcctcgtacgcaccaccctgtgcggtttcccgcatatccacatcttgggtttcgattgctgcgtctaccagagcgttcagggatgccagtacattcgtagtcatataattacgtcctcgtttagtttaaatgatatttacgtgcagatgcaggtccggcctagcgattcttaagtgcggatttaatgcctgcagccgcggctgctgccacaccgcctgccgccaggattgccaacagcaaagctacaccgccgtagaacggaagcagtacccaccaccaggaccaggcgataacgccagtcagtttcagggttacaaagataaggcccagtacagaacagattcccattttcatcgacactcctaattaggttttgattatgtcaccaacttttaaactaagagctgaggcttcatctttataccaccgctctgtctcagatttgtgcccccagcagtcatactccagggttacacgatacacctggtattgctcatcccatacaggagcatctactcgggtgacagttgaatccagtacattcatttgcttctccctacccaacgaccatcgtcgtcgagcagcatcggaattaactgcgggcaaccctcggtgattaccatcacacccaggattggtttcttgcgggtgagtctgccataagcaaaggccatgctcttgcggtcaatcaagcaccctgcatacgcaccaaagtacagcgccgttgaagaagcagcatactgaacctcgaagcgtccatgctcatgccccaacaccagagaggtgcgctcatgggatgcattgagcatgaaatcaccgctgacttgatgctggaaacggacaggccccagcggtgtgttgagcacccaagcgtcggcccacgaccacgccggagcaccatgctcagggaataagatgtcccggtacttcttgataaattgcactggcaaaccgtgagctttagcgcggcgatatacgagtgagccgtgattggaatcgcaaaccagcaggttcgggaatagttcatgcagctcctccagtacgagcttggctttctccagctccacccctgcgctatccaggttagggtcagagtcgtggaagctgatagcgtgcccgtcggtttcgtcacccacctgcactaccatgtccgggcagtacgcatcacgtacgctctcaaggaacggcattgcgtctacgtgggtatacggagcgtgcaggtccccgacaaccagaatgcggtggcacatatccggcacctttgtattcccgatatcgtccgttgggcttggttggattagcttacgcgcctcctgcagcccgcggttggcactggccttgctgcccttgttatccatgaagatgctgcgccagtagcgtacaagctggcgagacacgattacgtcccccctgcgaaatttgttattgtacgcaatagctgcatcagtgttatttaggaaactgccaagaatttgttggtgctcttctttggtccacagtttgattagacttactttagccaaggttgcctctcttgtgttgttcctactcgtatcacattaattctcggggaatcacagaatcaagccagagtcaacaaataattttatttaattatttagttgaccctagcatatttccatgctaccctaaccccctacaccacccaagggtccacctatcactactccgcgatgagcttgtactctccagcgaagaaggtgatgccgtccccaggcttctctgagttgctgtccggattgagtagctccacctcgccgaattcaacgtcgtaagatatcacgcgatgctgcgtacccggtgcaaagtaggcacgatgtcgtgggtcgataggctccggcccaagttccagcatctccacaatactgccaggtttaatattcattctaccttctccttactgtacatgctcgtacccatttcagcttccgccgggaagggcacctcgccaatgataccgtagttaggccagagctggtggatacgcttaggtgcatcctccatgcactgcttaaccagcaggctcgcctcacgtccaacctccgggttggcgctgtccagatacaatgcatcgtgtacgttcgtaatcaggcacacctgattgtcgaaccagtcacgggccaagagtgcacgcagaaccataccagccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtacatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggcagtccctcgcggaaagcgaggcggtaacagtgcatatccgtacctgcctgtagcaagcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacagtggcacaagtattcagccggtggtgtatgataccggaaccatctgggcgttcgggtattacgtactgcagcattcccttccgctctttgacttctccgtttgcatccagaacttcccgtaaatagtaggtaccggtgtccttctcaagcgccgccagctcattcaccaacttacagaactcgaacccttggcgggccagcgcctccattgcgtctgtgctggtgctgtatactggcgtaccgtcctgcagggtgcgcgcctgtcggaactctccacgctccgcatacttctcccggataacttccggcagctcctggatgttcactaggcccgggcagaagtaaaggtcatcctcccacttaagtttctcctcctctgtatcaaggcggaatacttttggtagccccttgttcttaccggacttgtacgtggttgcacctggcggtgcgggcacgtcatccacggcaacccaagtgtccccgacttgccagtagtcggccttgacgtactggggagggtcatagggcaccttcttgcgatacttgataggcccgccgtacaccagtgcagacatatgaaagtccgagccgaagttgaaatccagagtctccggtaggtccttcgggatatactgctgcagctcctgcttaatctcacagatgcgctgctcctgctcctcctggttcttgcgcgcaattggcatattaacgaacaggccgaaccattcgcagtacgcccaagccagcaaggcatccatacgctcccacacgtactgcatctgattgcgctgggtgaacgtagcacactggccgtagaagcacagggccgtgttctttatatcaccattgactaggtaatccctgagaagaatggggtctatctgcgaggtcagaacaccctgttcccacaatatttttaccccatcaatcttatgctccccaccatactttggcgcagtttcatccaaggatgggtacatactctgaaagtcagacacaatatactccccgtgcattgtgtcgaatacgcggccgccgcgctttaggaattcctcaaagtgttgccgctgatatgttaaaaaccagctaatttcgaaggctgcgttgtgggccacgatgcaccagcaatcagaaggtatgcggaaccacagatgctccccggctacgtcgtcaaggaattcctgcttgctgttgaatctgatatcaaaggtcggttctacggtaactgtgccgtcatcctcggtccggtctatgcggtaggccgaatgcactacatagttgtcagggcagtaggggctagccttgctaccatagtaaggattattctcgacctcaaggtctatagtcataatactgctagtcatactgcaaccccgtgattatggtgataccccgccgcctcagctgccagtctacgacactctacggcttgctctatactgctaaatgaacctaattgtttatttcctagggttgctatccaacgacctctcttcctgtgcacccctacatagccgctgcggttgcttctatacagggacttgttctgcatgttcttctcaggaagcactgccctcaagttatctggggtatcttctaacctgttatgatttatgtggtctatatggtggcctgctcgcagcggaccgttgtgcatctcatatactatcaaacttcttttgtatagcttattatgcagcttaacgtaccagtatccatgtactttgttcagagttcctgcctcggaacctgcggcgcagtttaggtggctgcgtccgcgcccacttctaacctcgtgcttccagtagagtttgccgtctttgtaggtaaaccaaatatcccaattcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcg

SEQ ID NO: 164 - DNA, 44715 bp, Unknown
  source: /note="Description of Unknown: MCoc9-1c Bacteriophage Sequence"
cgcttgcgctgaggggtatgaaggtaccgacactaacagtctatggaatctgtcgtgctacctagccccgcgtatgcgcgccgctatagaggaggcaaaccctgctgctgcggcagttatgtcgtacttgcagaacctcgctaggcgtgtaccggcaagccagcacctgcagtggtatacgccgctgggcgggctcgtaatgaaccgctacacacagcgtgaagaagtgcgggtacgaattgactgtatgaacctcacaatcatgcgcgtgcataatcgggatttcaagacctgtaacaagcgcaaggcagcctcggggattgccccgaactttgtgcacagcctggatagtacgcacttgatgatggttctatgtgccgccgagggtctggacattgtgccgattcacgactccctggctacacacgcagccgatgttgatactatgcaccggcacatccgcgagcagtttgtgcgtctctacgaagagcatgaccttcttggggatatcacccgcgcggcggcagcagctggtgcggacttgacggacctggatatgccagaggttggtactctggacatccggcaggtactggaatcacctttcttcttctgctgagggtatggtatgcgagtactagtaactggtgggcgagattacacagactacttagcactaaagaccgcaatggatatgctgccaaacaaaccatctgtagtgatacatggaaatgccagaggggcggacgcactggcagacaggtgggccctggaatccggtatttttgttctgcgtatgcctgccctgtgggatgtgcagggtaaatctgcaggtatgcgcaggaacgccgccatgatatccttggcctttccagaatactgcgtcgcctttcctggtggaaggggtaccgctggtatggttgagttatgtagaaaggccggtataccagtttgggtaccctactaaaatttaatgttaccggagtaggaatgaagttaaaacacactggtaaaacttccgattacactctcaaggttctgtataagtctgacgatattacagacgcagtgaagcaactgcacgaactgggccacggcattagtcggggcctggctcctgagcagcactactggagggtgttgggaagtatactgggtaaacagtatatactaggagtctatgactcccaaggcgacttagtcggtgccgtcagctactacccagaggctgtagaggactgtcattacgtagagcctgtgctatatacagacttcttcgtattgaaaccggacaacggcgcggcagtgtctgtgattatgcagggcctgcacgcaatagccaagtgcatgcgcgctgggcgtatcgccattagccggagcacgtctagtaacacgtacaaaacaacttatcatttagtgaggtcagaatgagtggtggtttaggtaaactgttaggcaaggccacggatatgctcggccttactgacaacgcaggattagaggcgcagcagcgcttggcagagcaacaggccagcgcagctaaacaacaggctgccttagaggctaatagcgccgcagataacattgctgagattgaccccgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcacgatctttacccgggacgattccctggacggtagacgcaggccgctggagcgagactatcagagcaccggcgcgcagctggtcaacactgcagccactaagattgtaggggccctgttcccacagggcaccagcttcttccggttctccaagagttcggacctggacgagttcattagttcgctgggcagcgcagctacagcagaatctaagctggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgtccaggacctgccagaagatttccgcggcaccttctaccgtgacaaagacccatacggcgacgttgatatctacactgccgcttgtcgcaaggttaagcggacagaggaaggcgtagaagtagtaagctacgaggtgtaccaagaagcagacgggcaccgtatcggagacagcagcacctatccagagctggagcttccttacaacgtgctggtgtggaaccttgttagcggcgaacactatgggcgcggcttggtagaggactacgccggggacttcgcccgattatcagtactgtcggaagcgttgactaactacgaggttgagtctgcgaggttaatcccgctgattgacgcaagctctgggttagacgtggacgagttctcaacgtcggagacgggtgaggctgtgcaggtgggtggtggcggttccaacgggaacagcaaatcccccgtcactgcttacgagggcggctctgcccagaagattcagtggattgccagcaacatccagatgctcgaacagaaactgtcacgtgcgttcatgtacaccggtaactcccggcagggcgagcgcgtcacggcctacgagattcgccagaatgccaaggaggcggaagccgctatgggcggcgggttcagtattctgagcgacacatggctgcgtaagctggcgtacctgtacaccgcactggtgtatcctcgctttaagctgtacctcagcgaaggtgtagtgagcatcaacgttacggtgggcacctctgcactcgctaaagccgcggcagcggacaagctgttagaggcggcgcaatccatgcagctggctatcccggtgcttgagcagattactccgcgcttcaacaaagatgcgtgcgtagattggtacttcgacgcctacggtatcgttagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctccccttagcgccccgaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggtaaggccctggagtatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatatcgtgggcggtaaggagaactgggaggtagcagcgcagctgtttaattccaaggcccctgaacctcttcgtaacgcggctcgtgcactcgctaactcgggtgagctcaagcaggccgctgagttggtggcaagcttctgccgggatatgggtcttatcaagacacagaacccaatggtacgcggtgtagccagcaacaatgcactatctgctgcggaattccgcgcagaatataccaaactccgtcaggaagcgggcaaccgtagcttggcgtctccacagttcagtcaacgttataacgatttgctcgcacgccgtgaagctggtaagcgcgtaggtctttaattttatttataaaggaaactaaagcatggccaacactatttataatggcaacctgacccgggcccactggggcggcgcggcgtctgacgtagatattcacctggaagtgtaccagaacgaagtggatacccgcttccagtaccaggctctgttcctgggcctctccagccagcgctctatcagcggttccaacacctaccgtattgaccgcctgaacacctcctcggtgaagggtcgtcgctctggtgaggcgctggatagcaccccggtccgtaacgataagatgattatcgtggtggatacggtgctgtatatccgtaacccgattgactaccaggacgactggaccggtccggacttcctgaccgagatgggccagaacaacggctccgagttcgcagagacattcgaccaggcgcacctgattcagctaatcaagggccgttcctgggttgctccggcgcacctgaaaccggcgttcaacgacggtattgaggtgggcgctgctatcctggttcctggcaccactaccgccacacagctgacccaggctgagatggaggctaacgccatgaacatcaacctggcccacaaggctggtattgatgaactcatcaagcgcaagaccccgctgtcggacatgattaccctggtggatgtcgatacctattcgcgtctgctggagcatccgaagctcctgaacctggaatttggcgcatccaacaacgacggttacaaagaccgccgtgtagttaagatgaacggcgtgcctgtggttgagtgcaccgagttcccaaccgaggccggtacgcacccgctgggtagcgcctacaccgtcacctctgacgatgcgctgtgccgcatggtgactttcagcaagtccaagaccctggtgactgttgaggctaagccgttcacctcccgtatctgggacgatgagcgtgagttcagcaacgtgctggactgctacgcgatgtacaacatcggcctgcgtcgtccggacaccgctgcagtgaccaagttcaccttcaccaccaagtcctaattggaggttcaatggcagtaatcgctacgttcggtctggagactctccaggccaatgcagctcagcgggaggcggttaaggccgccaccgatgtagctaagaacatccaggtggcttcggttgaatctggccgcaaggctaccaagaaaacccgtaaggcggctgacgtagccgctgatactgcggaagagtaatacgcgcccctggtgccttcgggtgccaggggctttttttttttgtccctgtcttaaaggtccaaggggtctttaatagaggaacaaatatgagagaattagacgctgttaacctgacgctggaagcccttggggagtctcgcgttatggacatcaacactagtaaccctagcgctggattagctcgctctgcactcgcacgtaaccgtcgtgggttactcagcacgggattctggtttaacgtggtagagcgtgaagttacgcccaccaccgacggcctgattaaggtgccatggaaccagctggctgtatatgacgcctgctcagaatccaagtacggggtacgtgacgggaatctatacgacctggtagagcagaaccaatacttcgatgcacctgtgcgtattcgtgtggtcctggatttggcctttgaggacctgccggagcacgccgctatgtgggtggctaactacaccactgcgcaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgtgctcgttttatggtttaaggagagtatatggcccagtccctagagggtaccattcagagcctgctgcagggcgtctcccagcaggttccaagagagcgccagcccgggcaactgggggcgcagctgaatatgctcagcgacccggtttcaggtatccgccgtaggccgccgggtgagattgtctgggaaagcacaatcgatagccctgggcttgattccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagcattgccgggctgacttatatcctgaatacggagatggccccgaacacaaccgtggacaatactgggcgcatcgaccccagcaccaccgggttcttctacgttaaatccgcagcattccagaaacgctggaacgtcaccgttacctctgcgggggtggactacactggggactacaccgcaccggctgctggcagcacgagcggtaacgctgaggaggtatcaggtgcctacgttgcccagcagctgcgggactctcttgtagcgaacgggctgccctccgggaacgtgagcgtacgtggtgcgtacctgttcttctacgggttgagcaactgcgtggtatcctctgacgcgggtgatacttatgccgtggtatccaaccagtcacgtgtagaccaggagcaggaccttcctgcacagctcccggcgcaagctgacggggcaatgtgccgtgtaggtacagcctcgtctgagacggcgtggtatcagttcagctacagcacccgcacctggtccgaggtgggggcgtacgatagcatcaccaagattacgaacatgcccagagagctcgccgcggatgacaacatcattgcgcgggattgggaggggcgcttagctggtaacgacgataacaacagtaatccaggattcgtcgagaatggctacatcactggtattgcagctttccagggccgcctggtcctgcttagtggtagctctgtggatatgtccgcctcgggcctgtatcagcgattctaccgctctactgtgacgtcactgctggatacggaccgtatcagcattagctctgcgtctgcccaggattctgtgtaccgcaccgctgtgcagttcaaccgggacttggtcctatttgctaacagcatgcaggcggttgtgccgggttcggcagtacttacgccaactaacgcaagcattagtattaccagcacctacgattgtgacagccgtgtgactccggtaatggcggggcagacagtaatctacccgaacaagcgcaacgacagctacgcgggtatattggagctaatcccatcaccttacaccgcggcacagtacactacgcaggatgccacggtgcacctacctcggtatatccccggtagggtgttgcagatgcaaaactccagcgtcaccaatatggccttctcgcgcatgtctggagagcgtaacagcctgctggtctacgagttcatgtggggcggaagtgacggcgctaagatgcaggcggcgtggcataagtggtcgttcccgtacccaatcctgagcgtacaggcgctggaggatgaggtgttcttgtacatgcaagggcccagtcccagcaacaagcttttgattgtgtctatggacccgcgcgaaggttatcagctgggctcagagtaccgcgaagcctactcggatttgcagaagcaagttcaagtgcaggacggggtgttcactgtcccgtcggtattgcgcccggttgggtgggcggacaactacaaggaagagcttatcctaacgtacctacccagcaaccctatggggcctactgaggttggcatcaaggagattgctggggagaacaccctacgggttgtgcgcggtgtacctgatggcacttatgtaatcgggagacgttaccgtagtacgttcacgctaactacgcctattctacgggaccagaatgacaagctcgtgggaagtgggcatgtgcgcctgctgcgcctggacgtggcagtacgtaactccgggcacttcgacgtacaggtactagacaccccgcgggacgtcaattggggtggggaactgactggtatcttgatgaactcaaaggagctgacgcttgggcaggccctgcgtatggacctggctacgattaccgtaccatgccgcactaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactgcaggcagcagcttccggcactatgggagcctctgttaaagacgcagtagccacggtgaacactgtagccgggcggcaagaggccagcgtgcgtgaccagcaggcaactcaggaagagggcttccgtctaatgacagataaggccgtggatagcggcctggctaacatggacatggaggacccctacgataacatgtttaactcgttgttgagtgtcggggcatctgccgttgggcagtacgctggtaacgctgcgtcgtctactgactctggtagctcttcgcctggtagcggagcgtcagctacgcagagcatggcatcctcctatgacttatgggggagtaagggcaatagcccagttcacacctggtaaattaggaggaatactaaatgcctgtgattcaacccagtagacaggggttaaatatcggtggcgtgcaactgcaatccaacgatgttagcttgccgtcaacggtaagtgaagtatctgttgatacctccaaagcaaaacgcctagccgccctgtctggattcgtgcaggacttcggcgtaggtttcgacgcggcagtaaaagaaaacgccgcagccgccaccgtgcgcggcgctatggatgctcagggcgcagtagatgcaatggcctccaaggacgaggctgtacagaagcaaaacatcttcgtgcgcgaagcctatcaggacggctacgtatccgccgcagcgtacgacactctagctaagtggcgcacagacagcatagcccgggctaagaaagctgccgaggcagggctgactgacgaggaattccagcagcaggagcaagagcacgtacagtcaatggcagacaagctcggggtgtatctcccggatatgtccaagcagtctgctacgagtatactgcagcagctccgcgctaccagcatggctaactatacagccttccagaaaggacgtgctgcgttcgccctggcccaggctgaccgtgccctagaccgtggactgagtgcgtccagcgatgagttctatcagcgtctgcaggcaggacagggtgccgccgcgcagatgtctatcaagaccggattagacagtatcctggctgccgagcacttggacaagaacaagaagctggacagagccaagcagtatctggttagcgtagcgcagcagacgcaggacccactggtaattaaccagctgcaggaaatggccaccaaggaactcggcgtcaactccgtggatgtcaacgcggcactgtatcaggagttcaagcgcgcaggtgctcagattgagacacaggcccgtttcgaaatctctgatgcaatacagtctcttgaggggcagacacctgagcagcaagaacagactatgcagcgtattcgtagtcgtgtcattgagctgtcggcatctgatgtacttagcgccgggaccagcatggagttctggaacaaagcccagaccattcgagagaaggcagcagacgcccaagcattgcgcacagcaattactgggaatatgccaagctctactctggcgggcatgttcaaaggggacttagataaggcacgtactcagctgctcaagagctttccggatacccccgaagggaacctgcagctgctggcatacggaagcaacagcaaggatgcgtgggccgtaaacgaggcgcacaagcgtatgtcttcggatatggcacgtacgctgactacgctggaccagctcggtgaagatggcgaggtttcccgcgagaacgtcaatagcatcaacttgtgggcacaggcttatagcaccagtacggacttagggaagatggcgctgctgtctgaggtcccatctgagtggcgtggagtggtgcagaaagctgttacgcaaaacccaaataatgccagtaacactatcttggacgatcttcgccgccaggctcgtaataaggcgagtgggcgctacagcaatatccaaagtaaccccacggacaagatggtagacccaagcggcacggctaactggttcagcttcttcggggatgcagacgcacagcgccaggaagcgcgagctgctatggaagatgagtaccgttatgtgtataaccacaatccggaatcccttgtagggaaggacgctgacgacatcaatacgatgctaaaaggcaatatccaatcccgtaagctggagctggacattgccggggcacctaggcatgtgtatctgcccgctggcacctctatgcaatctatcatgggtgattataagggcgaccaagagcagttcaaggcctccctgcagcagcatatacagaaccaggttcagtatatgtcagaccccagcaacatagagcgtgtagtagtgcaggccgccaccgctggcaacgcaggtcagaacatgaccgtaaccgtgttcgacaagaagggcaccttccagacgatgtctgtgaaccttcgagacgttcagacgactgcgcaggctgcgtatgactcagcactggctggagagatgaagattggaagcgagcaagtaggtgtacgtcctgccaccttctacgaccacgacaacgggcgtgccgtcagcgtacaagtaaatggccgtaactcggtagggctggaaccatcactgtttagtgacatcctagccactactatgaagttcgaagggttccgagaaggcaagggtaagggtagcgtaggcttcggcctgcacgttaactctggcatgcccgtcccccagaaagttaccattgacgacggtatcagtatcctcaaatcctcactggaggagcagtacataccgaacgtgcagaagcaactcaagggacagggtttgactgcctccgacgaggcgttaaaggttatggtggacctgaactatcacggtggtaacggtagctccggccccgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgggcgtaagaagtacctggaacaaaacctacgtgattggctcttcgaagcaacgcactaaccagaggcccttcggggcctccccttatcaaaattcttttaggagatattatggctcagtttctgaaccaagaaccgaatccacaggaaaaggattctgctaagggcgcaacacttaaatctgcgcctgagcgcgtagattggaacgatgccggggacaacggtctgaacgcactggggcgtgcctcattactggcacaggccaagaccccagctactacagccgcagagagctttgcctcgggtatgggcaacagcatcatcgccgcagctatacgcaaggcctctgccccggcatttgaccgagacccgaactttaatgccaagcagaccctgagtagcgatactcgggctaagctgtacgccccaaatcaggaagagattgagtacctgcatgactccgtgtcagtagaagattacaactaccgcatgcagcagatgcttgagcagcgtgaccgtgaccgcttaatggctgacaacacagtagctgggttcgcgggtatgttggtaggggattccccgttcatcctggccccgatgtctgctgctggtattgctggccgtgcgggcttagctgcacgtaccgctatacgcgctgctgatgtaggtactgcattctatgcacaggaccaactggggcagtctgctgcggtaactgcactgatagcgggcgtagctgggttagaccagctctgggatatgtctagggctgctaaagctgccgccaaggctcgtactgggcgtgagcctatgttcgacccagaagcgcctacaactcgtacagctagggatgctaatgttaccggagtaggagagggagaggaaattctcactaagacactggatgaaagcatccaagtatcgagaaacaataccgcctccgtgaacatgaaagcacagcacgtagttcagttcttgaggaagtctgagcacttgacagcaggacagaaggctattctggacacgctgggcgatgctgtaaatgacattgattttaaactagtagcaggctccgcaaaccgcagccgctacacttatgcacaacaagatttagctaagcggggagagatatccctgcgcgcgcctaagcaagctaacggcagcacctggactacagtcggtgatgcgctgcgcgctatggatgcagatacaagcaaggtggccgtgcacgaactgattcatgccgctactgcgcgcgctattgacagtaatcccgagattgctaaacgcctggaggaagtgcgcgctgttattgcggctgattccaccctgacaccgcgtatgcgatattacgcaagtaatgtgcacgagatgctggcaggcttaggcgacagccctgagtgggttgagcacctggcacgtacgcagtctcccaccggcaatagcatgctccgccaactgggtgagtacatcatgaacgctctgggcatcaaggccaaaggctctgccttggaggatgtactggatgcgtatgaggatgcagttaagtggacagctaaggattatgcagaccaagcccagagcttccgtagtgaggctttccaggacctggcgggcagcactaccctcaacgaggctaagcgtgcacaagctatgctggacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgcccgcgccagcgtagttgaagatgctatcctaggcgcgttgaaggataagggtgtaggggtgctctcacgcttcttccatcggagtaatttccgcgctgagcgggctgcgctggaggaccgcctgagcaagtacctggatgctgcctacagtgctgacgtaaacggccgcgctgtgccggtgccggatgcagagattgctccgctggttgatgcttaccgccgctctggctgggctagcaagtggcacgagcatatgctcaatgccggtctagtggatgatggtgcgttggttaaatccgactactacttcccgcgccagtacagctacgacaagatgcgccaaggtatcgcgcagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatcccctgcgcggaacctgcgtcagcgtactcggttcaacatggacaaagagtacctgattaacggaaagagcatgcgtatgcaggacctgatggatactgacgtagccaaggttatgcacgggtacactaaccgtatgtctgggcgtgtcggtatggcctatgcaggcgtacaggacctggggcagctcgctaagatgattgacgagtccaagcacgtactggcagattctgctaagtgggagaagaccgtcaatgacaccatcgactttatcctgggtggggcacctgctgacgctgggcagcttccggacttgctgcgcgcagccgggaacatggctaacgccactatgctcaagaactccggcctgtatcagctgaccgacactgcgttggctatgaaggagtttggtatggcccgtgtgctgcgcagtatgcgagaccaaccttggttcaaggaaggtgccgtagctatcaagactccggatatggctgcccgcctagacactgtgctgaggggaaatatccagaaggagatgcgcttccgctggctgaatacgtacgctgacgataacctggacctgacccgtcaggcctcctggttcaacgtcactcagaacgttgggcaggctgcacgccacgtcaacggtatgagcatggtgcatcggctgcaggttaacctgaactccggtattgtggcggacgagcttacgcagatgttcaagggtgatgctgaggcgtttaagcgtctggagcgtttcgggcttacccgagatgttgcggaccgcgctatcgctgccaataaggctaacccgggcgccatgttccagccggacctgcagatgcaagttgaggttgtaggggcgcgtatgatggactacctggtacagcagattcgtactggagagacctcacactttgcacagttcaaccctatcggcaaagtcatcgtagggtaccagagcttcgcactggctgccactaacaagattctgcgtagagagctgaacgatgctgggtggattggtgtagcccacattatggcataccagttcccgttgatgctgctggctactatggctaagcatggcatggatgggaaggacgtagacacccagaaactcatcagtgagtccgtaacgggtatgagtgccatcggcggggtatccttactgcaggatatcttcctgggggattctccccgccactcgttggcgtctatgggttatgtcacagggctgctcggggccgtacaggacctggctactggtaatatggacatcaagaccttcactaagcaggtaccgttaatccaggaattcgcacctacgcgagctatcatcaataacttcggagacgattaatatggcgttcagctggcaagaacaaatcaagccagctggtacccaggatatccagtgcgatattgagtatttggacaagtcctatattcatgtatacctagacggagaggaaaccactgggtacacctggaccagctctactaatatcaggctgaacacagccttaacggcggacactacggtgctgctcattcgcaagactgagcgggagtacttgtatattgagttcgccagcggctctccgttcattgaggtgaacgtagattctcaaaacacgcaattcttacacctagcccaagagcttgtggaaggccgagctatccccggattctacgggaatataagcatgaacgggtaccgcatcactaacgtagcggacccagaagacctgcaggatgtggcaaccaagaactatgtagatactggtgatgcggcactaggtgtccgtattgatgccgaagccgccgcgcgcaaagccgcagacgatgcgctcgatgttcgtactaccaacctagagcagacctttatctcgggggagcctacggtaagctatccctggtatactatactggccgaggctactgacgaagttacgcctggattgtctttcacaaaggctatagtgtacgtacaaggcgtaaatcagattccgggctacagttttgaggtggtggataacactctactgtttgcagaggtacttccagctggtactctagtgtctgccagattggggtatgatgcagagctttcggaaacttacgctacagctacggcattaggggaagaggcgtcagccagggctaatgccgatgcacagataattctggattaccaagcagcagtagcgaccaaggcagcaaagggtgctaactctgatatcacgagcttaagtggattaactacaccgctgagtaaagctcaaggcggtactggcaacactactggtgccgctgattcagctgcgaagctagccacagcaaggactttggtggtagatttgacatccactacaccggccagttttgatggttctggcaatgccaccttaggggcaactggcagccttccaattacaaaggggggcaccggagctggcgatgccgccactgctaggactaacctgggagcagcggcgtccggcagcaacggagacatcaccgcattaacaggattgagtgggggtatatccggccgcactgacggtgcagctgcagccgccggtgtagtgggggaagtactgagtgccgcaacctctgcagccgtaagtgttaccagcggcaccccattgaacgttctgtccttgagcctgccggcgggggagtacgagcttgagagtgccctgttagtcactaatagcggcaacgttactgctctcagttttggagttagtagcaccagtgcagtgttacctggaaactggtacgacttatattctataaccaccacgttagcagctgggaattcttccagacagggtatgtcgcgccgtctactgttgagtgcaacaaccactgtatacctggtagcgcaggccacctttaccgggacctgcactgcccagggttatattagagctatgagggtaagataatggcaggggcggctaaacgcagtcgcctctcggagctgcaccgcatgttcactgaggccttgattgaagaaatcaagcagtccaaggaagacgaggtgccgctccccgccgcagataaatcggttatcgctaagttcttgaaggacaacgacatcaccgcggacgcagattccgaggagatgcaggaccttcgcgacgagttcgatgacgaactagcggcgcgtagagaggcgcgtaagcaagagattctaaataaagttggtggctcagactctgaggacttactagaaggaattgtataatggtatcggtgaagactgcacgaagactgcgcatgctcaaccagaaacttactggttatagtgcgaatccgcgcagtattcccaaagaggagcgcgaggatatcgccatgatgatggcggctgccctcagtgactttcgggaattcgcatacatcggtatgcgcttccttggttttacgctcacggacatgcaggccgacattgcagagtacatgcagaagggccctaggaagcgcatggtggccgcgcagcgtggtgaggctaagtctacactagctgcgctctacgctgtctggaggctcatacaggaccaatcctgccgtatcctgattgtgtctggtgcagagaagcaggcgtctgatgtagcgaacttaatcattcgtatgctggaaacctggccgctgctgtgctatttgaaggctgaccctactcgtggggaccgtacttcattcgaaggttatgatgtcaactgcgacctgaaacctctggataagtccgccagcgtagcctgtgtaggtatcactgcatccctgcagggtaagcgcgcggacctgctgattccagatgatatcgagaccaccaagaacggtttaacacaaacccagcgcgagcagctgctgatgatttcgaaagactttgcggctatctgtacgcacggggatacgctgtacctgggcacaccacagaccaaggacagtatctataagaccctgccgggacgtggcttcgaggtccgcgtgtggcccgggcgcattccgtctgttgaaatggaggagcgatatggaagtacacttgccccttatatccgggagcttattgagcgcggctataaacgcaccggcttcggcgtcgacgggacgttaggcgagagcactgacaccgggcgctatgacgaggatgcgctgattgagaaggagctggacttcggtccggaaggcttccagctgcagtacatgcttgacaccaccctgtccgaccaaatgcgtacgcgtatcaagctttcggatatgctggtttactccggtagccaggattcctccccggagacattctcctacattgcggaccgccggtacctgtaccagcacgagcatgaggggattatgggccagcagatgtacttcccggcattctacggggacatgcacctgccgtaccagcataaggtgctggtagtagacccggctggttgtggcggagacgaagtgtcctacgctgctggcggcgctgcgaactcgtacattcacctattctccgtaggcggcttccaaggaggtatcagcgaagagaacattgataaactgattgacctgtgcgtagagctagacatcccggatatggtggtggagagcaacatggggcatggcaccgtgtctatgcttatcctgaaccggttacgggagcgacgtctcgccggtatcggtgtacgggatctgaacaactccactcagaaagagcgtcgtatcatcgacacaatcagcccagttactcgtcgtcaccgcctggtagtgcatgagcgtgctattcacgatgatattagtacctgtatggcgtattcccgcgacaggcgttggctgtactctgcgttcgcgcagttgtctggcattacgtacgaccgtggtagtctggctaaggatgaccgcgctgacgcaatcgccatgatggtggctacgctgaacgggcacctggtggaagatgagaaagtggtggctgagcgtgagtctgagaagatggctcgggccttcattgataacccgctggattgggcacagagcaaagtgtctaagggccttcggggtgtagctgcacggttacagaaccggggcagaggtaaacaacatagaggaagaagataatggcatttgcagaagcaacactggcacagcgccaggcagtacgtaatgcagcagtagcacttgataaagcaacaaccttagcacatgatactggcccattagatactctgggtccggatgtagatgcagccggggctgtagcagtagcggcactctctgctgcaggggcctctgacggcggcactgtagtggtggtcagtaatggtgcggaagtaaccgtacccattacgttcaccaccgctcgggaggcagaggctactgccaccgtagcagcgactatcactgtagaagatggtgtaatcacagcaatctctattgagtaaggagtaatactatggcaattgcaaaagcaacctcagcgcaacagcaggagctgctgcgtcagctgaacattctcggtaaggacctgtatgctatccttacgcagccgcagaacgtagcccagactggagccgccttcgacaccaagattgctgcgcttgaagccgcagtagccgcagtgaaggctgctagctaatgcgtaaactggtcgctgggttactgctcgcggttactctgactggttgctcggcgacctctgcactcaccggcttagttggttctaagccggatgtgtctgctcaggttggtgccgaaaacaccaagcaaaccgttggcctgaacaacaaggtggacgccagcaccaccaacaaaaccgatgtatcagattctaacgtaggcaccctggacacgtccagtaagaagcaggtacaaactattagcaccgggacaatccaggcagaacgcctgcaggtggttaacaatgatagttacagtcttatcctcgccggattagctggggccagcattcccctggtcttcctagtggtcattctggtgattcgtaagctattcaggaagaaggggcagcaggatgattaaggtaggagacatggttgggtcggacctcgctacccgggcaggtgcagcagttaccggcgctacggtatcaggaggttggttggcagagttaatgagctggaactggagcactatcagcttcatcactgcgacggtgtgcgcagtgctaaccctggcgtggaatgcgtattacaagcgacgtacattcaagctcctagaggagcaggcacgtaaggggactattaaatatgagtttaaggactaaggttattgcggccctcacgggggccactatgctcggcggtgccattaccggcgtagtccagcacaacgagggcctgagccttaccgcctacaaggatagcgccggtgtccctacaatctgctatggcgagaccaagggcgttaaaatgggccagagagccacgctgagcgattgtcagaagcaactgatacaatcagcaggggaacacgcaaaggcccttgacgggcttcctatgcagctctctgacgtagccctggttgggtctatagacttcatttataacgtaggtgtagctggcttcaatggcagtgccgtgaagcggcatctcaagagccttgattatgcggcagccgggaaggctgtactggactggcgttatattagcaagtaccagcagaagtccccgggcaccggttgggtgtataagggcggcaaccgctggacctttgactgctcccagtatattaacgggcagcgcaatagagtgtgctggggcctatgggagcgcaggcagtggcagagcaaagccatcgggaatcagtataagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgaccggattcttccggcaactacgcagcagctattgagcgggtttccgctaaaggtgtaaaggtgctgcgcgtacctgtggggtcttattatgttggggactgccacctaactaaccctatgctgtttataggtgatggcctagagggcgtcaacccgcttggggctgtattcattaaacctagcacagctgctaagatgttctactttgacggtacaagtacacgtggaactgggggcggattcctcagaatgcgactgcaaggggctgtcagcagtgattcgggacttatggttgaagtcacctcctggagctattttggggcggagaactctgcttttaataacttagcgggatctgcgctggtgttgcgtgactgtatggagagtcacatctcaggaaacttattccgcaggatgggtgcctctaacggcagtgttatactcctaggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactggactttggacagctgtcacgctcttggattacccgtaatggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaacccgcctcgcgtatacagcgggaacatgaacgtagtgcgcggggatagtccgttcggccctgggtttatcgggcaggcgtacatgcgcggggctgccgctgctagtcgtaccactagggctggggctgctagtactgtagcactggatgttcctgcgggtcaggagatgcgtcggtaccagttgccgctgcaccttctcgggtctatagtgcgagtatccttgcgagtctacaaccccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgcgctcgttctgttccatttagctttgcgtggaccccaggtgctgtagctgccggtacgctggtatctagccctgtacagactctcccatacgggattactcaagcccctgtcggtttgagttctccggtatttaacgggtctgttgatgggctgctagccggtgtcagtagctacagtgggtacagctcctacaaagttactctgtttaatcctggggctgctccaattacccccggggctactcgggctagcttggtgctgcacttctaatgcacagcgtaaaacccaggcccagtctaggcgagcaggtctatacctggacctgaaatttattagactcacgcgagcccctccctcaccctcaacgacgccaattgcccccatagggggtacctagcgtcaatttaggggggggggggggcactgggtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcgtcacagtgtggcacctagtgggccagctagtgcgctgtagtgctatccctagtgctatccctagtatgcactaggctatccactggctatctttagtgctttacattgtgccgattctatgctacgctgcgcgctccccactagggcgcacttccactacccggcacactccagcgctatccagcgctatccagcgctatcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggtgtagactaccctcacaatgagggtccactgcaggcacttatgggtctacgtactgtcggcatgtacacctcgggtttagaggtaactataggcgggatactgcacccaaaataccgcgaggtgatgagggttagtgggccgttgcaaaaggtggacttgtaccggtccggaactttctacgaactcctttctccggcgcgaatcaccatcgacagcaagttctgggaacgccgccgcgacttctatgagggtgatgatgtagtggttgagcgcgtggttgcgtgcgtggaagagttcaccggctacaaggtgcacaagcaggccgtgcagttattcgagcgcattatgcttgcaccagaagagcggcagcgccgggagtacactggctacaattacggacgccacatccgtgacatgagcgccgcggcgctgctcatgaagttgcacggtttcgtagtgtctagattcgccgtgcctttgggctttggtttccgcaacggtgagcccatcgtgatgctggggcagcctcgaatgcacaaggacttcgccgcagttactgagtaccgctgcgtagagatgcgcgtaggtaagtggctcgctaactactacggaaatggtgtggacttccgcgatgctatcgaagacctcaaggctatgaacgtagaccctaaaacgtacctgtgcaagaccgagcaggaatggtacgacgcctacgagaacggcccgggtagctgcatgagcgggtactcctttgagcatagccctgtgcgggcgtacgctactaccagtcacgggctgccggataatgggctgcgcctgttcatccagtacaccggggagctgttcggtgacgacttcgaagtgcaggcgcgagcaatcgtgaggccagaaactaacgagtatgttcgtgcttatggcaacgctgcggatgcaatcctgcgcggacatgggtacatcagaaacactgagtgtctcgaaggggtaatgctggcgcgtataccacacccgcaacacaccggtgcggtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagaaggggtagtgcatgaccaagaagaactggtgtttgcacaggaccggcaggtgcttattgagcacgcagaagaacatccagtgcacgggctaattctcactgaatatgcagccgattgcttgggagagaagtatctgggcaacgacgatgaagaagaagtagaggaggcagcttaatgttcttgaatcctcacgggattgatatgcagctgctcttgcagatactgcaaacgcaccggcctagctgggcaagtaccaagtggttcgagccgctgcttatgcaggcgcttggtagtggtatgcactacgtaaaggacaagcacggaaactacttcgtgctggtgggggactcagagcaaagcgacgtggcatttacgtcgcacctcgatacggtggcccgtccaaccagcgctgcgccggacgtcggctgcactaacaagggtgttctgttcgtaaagaatccgcagcaggctgactgcttaggcgcagactgcggagccggtatctacctgatgctggagatgctgcgacggggcgtgcacggacgctactgcttcttcgtggatgaagaggttggctgcgaaggcagcgctgcatcggtcaatgatgacactgggttttggactggggtcaaggcgatgattagctttgaccggcgcggcgacggaatcattacgcaccaacggtacatgcgctgctgctctgatacctttgccaagatcctagcagagcgcctgggacgcacggagcagcacttacagaagggggtgtacactgactcagccgagttcgttggtatcattcctgagtgcaccaacgtaggtgtagggtacatgcacgagcacaccccggatgaggtactggacctgaacatcctggggcaagtgcttgagcgggtactgcaagatggtacgttctcgcacctaccgattgagcgagacccgaaggtaatggagccagaccaatggctctctgcaccaacgctcagttcacggcagccgtgggacatgcccccggacgaggacccgcaattactggccgcgttccgggaagtgtcacagctatctaaacagcaattggttagctgggtgcaggagaacccagagaaggcggcggagtacatcatggtgttctccgattatggcttcaaacaggagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctatatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcctgggaatactattgccaccgctgcaagcaagtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacagcaaccgaagtgggtaatgtacggccagccaataccgttcgctgccgcggcacctgccgcagcaccggctgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccatggataatgaccaagcgggacactccggcgcggccatgatacgccgtgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacctctgcatagaaaggtgtgttgctcggcgaacgatatatctccggagagcatagcggggctagttgtgcgccataagtgtgacaacccgagatgtattaatcccgagcatttagaattaggtacggtcaaggataacgtccatgactgtattgccaggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggatctaatagttgtgcgtgcaatgtgcacgcagaaggtgtggaaccggctgcgagagcagatacccaagtctatgcttgcgccggacacttcgaaccttctggactgggtggggttgtactggaacacttacccggagcaccaggaggtgcaatgggatgcgatgcagagcatgctcaacctccgggcggggcacttgtcccgggaagagagggtaatcatggacgagcttatgcggggagtacaagccgtgccgcaggattctgtggtgggcattgtccagaccctgaatgagctggcctacagcggggaggtagcagcgctgacgcagcgctaccaagatggcgaggaggttgattaccttctggagatgaagcacttgcagcgcaagtacggggacggcgctgctgttcatgattcgctgcttgaatgggagagcggaagtgttgatgaaatacttgccgcgactgacgagagcggcggtcttaaactgggcgtgttcgagcaactcgctagcagcatccgaggcttacgcggcggggactgcatcgcagtggctgctcctgtggactctggtaaaactagcctgcttgctgctattgctgtggactttgctgagcagatgcagcagcagccggaagtatacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgcgcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcgggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatgggttaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgagcagggttgcgagttattatcttgacggggcgctctgatatagtacgagcggaaacagaggcctggctggagcggaacttcgttatgtactccgagctggttatgaggccgcacagtgacaaccgaaaggatgtcattatcaaagaggagttcctgcgcaaccaagtggggttagaaaacattgtggcggcttgggatgacagccccgcggtgattgagcatttccgcggactgggtattaccacttacgctgtatgcgactatggtgcagcagcacatcgaacagacttaaaatcccacggggtggaggaattagcatgagtgcagtaggtacaggcatgaagtatgacgcagacaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacggcacatgctctgggggaaacactggactcggagagcgggttgccgcacctggcgcatgccgcttgttgtgcattatttattctagaactggagcagatggatagtgcggccgagtgagtggtgccacgggatgtggcagaaagcagtagagcggggcgacgaaagctccgctaaagactacctggagatgtataatctctgggtcagccgcaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgggcacgtaagctgattacggacgcattgcagaatggtgggattatgaacctgccgatgacgcagcgtatgctcacctctgcatatgaggtggctgctgcagctatcgatgagatgcgaaatgtcaaagccccaggcattggtgggaagtaccgtcggttcctgcgcttaatccccttggatgtcctgaccaccctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagccccagcgtacatggaccgagtatatgagtatctcacagagcgccgtacgaagtcccctacgcacatcctgcgtacgctccgtgccagtgccgagaacgtacactatgggcacgagccttggaccaatgcccagaacatctccgtagggcgtctgctgtgtgccgcagtgtttgagacgggactgttccagtggaagaactgtagcgggaatctgagcatgctctatccggctgacgacgttatggaggccttccagaaactggtagagtccgctgataccgtaaccatgaagccacctatgctggtaccgccggtgcagcacactactctgtgggatggtggatatctcacccctatcgacaatcgcggcacctatcataattctcatatcgaccgcgcacgtctccgtgaagtagcggaagcatttaaatccgcggatggcatcaaaaaggcgcttaataaggcacaggaaaccccgtaccgtattaataagcgcatactggaactggtgcaagaagcacgggccctgggtgttgggataggtatgcctcgctcagtaccggagcctaaaccggagtggtatctggacggggttcctaaagagaactacacagaggaagagcttgaccgcttcggtgagtggaagacgcgtatgtccctgtggtacagtgctgaccgtaagcgcgtatcgcaactacgcagccttctgactacgttggagatggcagaggaattcaaagatgagaaagccctgtacttcccgacttgtgtggactggcgctaccgcctgtacttcaagtcctcgctgcacccccaaggttctgatttgcagaaagccctacttgaattcggacgtggtaagccgctgggggagcgtggcctattttggctcaaagtgcacgtcgctacatgctttggttatgacaaaaccctatccgaagaccgtgcagcttgggctgatgcgaactttgcagagattgagcaactcacaatctctccgtttgattgccctgcttttgccaaggcggactccccctggtgtttcttggccgccgctatcgacctggttaatgctattcgttctggatgcccagaagagtatattagccgaatcccagtagctatggacgctacgaactcaggtgggcagcacctctcagcgctcctgagagaccctgtgggcggtcgtctgacgaacctgtactgggagggtaacgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaagg

SEQ ID NO: 165 - DNA, 44711 bp, Unknown
  source: /note="Description of Unknown: MCoc9-2c Bacteriophage Sequence"
gtgaacgtagattctcaaaacacgcaattcttacacctagcccaagagcttgtggaaggccgagctatccccggattctacgggaatataagcatgaacgggtaccgcatcactaacgtagcggacccagaagacctgcaggatgtggcaaccaagaactatgtagatactggtgatgcggcactaggtgtccgtattgatgccgaagccgccgcgcgcaaagccgcagacgatgcgctcgatgttcgtactaccaacctagagcagacctttatctcgggggagcctacggtaagctatccctggtatactatactggccgaggctactgacgaagttacgcctggattgtctttcacaaaggctatagtgtacgtacaaggcgtaaatcagattccgggctacagttttgaggtggtggataacactctactgtttgcagaggtacttccagctggtactctagtgtctgccagattggggtatgatgcagagctttcggaaacttacgctacagctacggcattaggggaagaggcgtcagccagggctaatgccgatgcacagataattctggattaccaagcagcagtagcgaccaaggcagcaaagggtgctaactctgatatcacgagcttaagtggattaactacaccgctgagtaaagctcaaggcggtactggcaacactactggtgccgctgattcagctgcgaagctagccacagcaaggactttggtggtagatttgacatccactacaccggccagttttgatggttctggcaatgccaccttaggggcaactggcagccttccaattacaaaggggggcaccggagctggcgatgccgccactgctaggactaacctgggagcagcggcgtccggcagcaacggagacatcaccgcattaacaggattgagtgggggtatatccggccgcactgacggtgcagctgcagccgccggtgtagtgggggaagtactgagtgccgcaacctctgcagccgtaagtgttaccagcggcaccccattgaacgttctgtccttgagcctgccggcgggggagtacgagcttgagagtgccctgttagtcactaatagcggcaacgttactgctctcagttttggagttagtagcaccagtgcagtgttacctggaaactggtacgacttatattctataaccaccacgttagcagctgggaattcttccagacagggtatgtcgcgccgtctactgttgagtgcaacaaccactgtatacctggtagcgcaggccacctttaccgggacctgcactgcccagggttatattagagctatgagggtaagataatggcaggggcggctaaacgcagtcgcctctcggagctgcaccgcatgttcactgaggccttgattgaagaaatcaagcagtccaaggaagacgaggtgccgctccccgccgcagataaatcggttatcgctaagttcttgaaggacaacgacatcaccgcggacgcagattccgaggagatgcaggaccttcgcgacgagttcgatgacgaactagcggcgcgtagagaggcgcgtaagcaagagattctaaataaagttggtggctcagactctgaggacttactagaaggaattgtataatggtatcggtgaagactgcacgaagactgcgcatgctcaaccagaaacttactggttatagtgcgaatccgcgcagtattcccaaagaggagcgcgaggatatcgccatgatgatggcggctgccctcagtgactttcgggaattcgcatacatcggtatgcgcttccttggttttacgctcacggacatgcaggccgacattgcagagtacatgcagaagggccctaggaagcgcatggtggccgcgcagcgtggtgaggctaagtctacactagctgcgctctacgctgtctggaggctcatacaggaccaatcctgccgtatcctgattgtgtctggtgcagagaagcaggcgtctgatgtagcgaacttaatcattcgtatgctggaaacctggccgctgctgtgctatttgaaggctgaccctactcgtggggaccgtacttcattcgaaggttatgatgtcaactgcgacctgaaacctctggataagtccgccagcgtagcctgtgtaggtatcactgcatccctgcagggtaagcgcgcggacctgctgattccagatgatatcgagaccaccaagaacggtttaacacaaacccagcgcgagcagctgctgatgatttcgaaagactttgcggctatctgtacgcacggggatacgctgtacctgggcacaccacagaccaaggacagtatctataagaccctgccgggacgtggcttcgaggtccgcgtgtggcccgggcgcattccgtctgttgaaatggaggagcgatatggaagtacacttgccccttatatccgggagcttattgagcgcggctataaacgcaccggcttcggcgtcgacgggacgttaggcgagagcactgacaccgggcgctatgacgaggatgcgctgattgagaaggagctggacttcggtccggaaggcttccagctgcagtacatgcttgacaccaccctgtccgaccaaatgcgtacgcgtatcaagctttcggatatgctggtttactccggtagccaggattcctccccggagacattctcctacattgcggaccgccggtacctgtaccagcacgagcatgaggggattatgggccagcagatgtacttcccggcattctacggggacatgcacctgccgtaccagcataaggtgctggtagtagacccggctggttgtggcggagacgaagtgtcctacgctgctggcggcgctgcgaactcgtacattcacctattctccgtaggcggcttccaaggaggtatcagcgaagagaacattgataaactgattgacctgtgcgtagagctagacatcccggatatggtggtggagagcaacatggggcatggcaccgtgtctatgcttatcctgaaccggttacgggagcgacgtctcgccggtatcggtgtacgggatctgaacaactccactcagaaagagcgtcgtatcatcgacacaatcagcccagttactcgtcgtcaccgcctggtagtgcatgagcgtgctattcacgatgatattagtacctgtatggcgtattcccgcgacaggcgttggctgtactctgcgttcgcgcagttgtctggcattacgtacgaccgtggtagtctggctaaggatgaccgcgctgacgcaatcgccatgatggtggctacgctgaacgggcacctggtggaagatgagaaagtggtggctgagcgtgagtctgagaagatggctcgggccttcattgataacccgctggattgggcacagagcaaagtgtctaagggccttcggggtgtagctgcacggttacagaaccggggcagaggtaaacaacatagaggaagaagataatggcatttgcagaagcaacactggcacagcgccaggcagtacgtaatgcagcagtagcacttgataaagcaacaaccttagcacatgatactggcccattagatactctgggtccggatgtagatgcagccggggctgtagcagtagcggcactctctgctgcaggggcctctgacggcggcactgtagtggtggtcagtaatggtgcggaagtaaccgtacccattacgttcaccaccgctcgggaggcagaggctactgccaccgtagcagcgactatcactgtagaagatggtgtaatcacagcaatctctattgagtaaggagtaatactatggcaattgcaaaagcaacctcagcgcaacagcaggagctgctgcgtcagctgaacattctcggtaaggacctgtatgctatccttacgcagccgcagaacgtagcccagactggagccgccttcgacaccaagattgctgcgcttgaagccgcagtagccgcagtgaaggctgctagctaatgcgtaaactggtcgctgggttactgctcgcggttactctgactggttgctcggcgacctctgcactcaccggcttagttggttctaagccggatgtgtctgctcaggttggtgccgaaaacaccaagcaaaccgttggcctgaacaacaaggtggacgccagcaccaccaacaaaaccgatgtatcagattctaacgtaggcaccctggacacgtccagtaagaagcaggtacaaactattagcaccgggacaatccaggcagaacgcctgcaggtggttaacaatgatagttacagtcttatcctcgccggattagctggggccagcattcccctggtcttcctagtggtcattctggtgattcgtaagctattcaggaagaaggggcagcaggatgattaaggtaggagacatggttgggtcggacctcgctacccgggcaggtgcagcagttaccggcgctacggtatcaggaggttggttggcagagttaatgagctggaactggagcactatcagcttcatcactgcgacggtgtgcgcagtgctaaccctggcgtggaatgcgtattacaagcgacgtacattcaagctcctagaggagcaggcacgtaaggggactattaaatatgagtttaaggactaaggttattgcggccctcacgggggccactatgctcggcggtgccattaccggcgtagtccagcacaacgagggcctgagccttaccgcctacaaggatagcgccggtgtccctacaatctgctatggcgagaccaagggcgttaaaatgggccagagagccacgctgagcgattgtcagaagcaactgatacaatcagcaggggaacacgcaaaggcccttgacgggcttcctatgcagctctctgacgtagccctggttgggtctatagacttcatttataacgtaggtgtagctggcttcaatggcagtgccgtgaagcggcatctcaagagccttgattatgcggcagccgggaaggctgtactggactggcgttatattagcaagtaccagcagaagtccccgggcaccggttgggtgtataagggcggcaaccgctggacctttgactgctcccagtatattaacgggcagcgcaatagagtgtgctggggcctatgggagcgcaggcagtggcagagcaaagccatcgggaatcagtataagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgaccggattcttccggcaactacgcagcagctattgagcgggtttccgctaaaggtgtaaaggtgctgcgcgtacctgtggggtcttattatgttggggactgccacctaactaaccctatgctgtttataggtgatggcctagagggcgtcaacccgcttggggctgtattcattaaacctagcacagctgctaagatgttctactttgacggtacaagtacacgtggaactgggggcggattcctcagaatgcgactgcaaggggctgtcagcagtgattcgggacttatggttgaagtcacctcctggagctattttggggcggagaactctgcttttaataacttagcgggatctgcgctggtgttgcgtgactgtatggagagtcacatctcaggaaacttattccgcaggatgggtgcctctaacggcagtgttatactcctaggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactggactttggacagctgtcacgctcttggattacccgtaatggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaacccgcctcgcgtatacagcgggaacatgaacgtagtgcgcggggatagtccgttcggccctgggtttatcgggcaggcgtacatgcgcggggctgccgctgctagtcgtaccactagggctggggctgctagtactgtagcactggatgttcctgcgggtcaggagatgcgtcggtaccagttgccgctgcaccttctcgggtctatagtgcgagtatccttgcgagtctacaaccccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgcgctcgttctgttccatttagctttgcgtggaccccaggtgctgtagctgccggtacgctggtatctagccctgtacagactctcccatacgggattactcaagcccctgtcggtttgagttctccggtatttaacgggtctgttgatgggctgctagccggtgtcagtagctacagtgggtacagctcctacaaagttactctgtttaatcctggggctgctccaattacccccggggctactcgggctagcttggtgctgcacttctaatgcacagcgtaaaacccaggcccagtctaggcgagcaggtctatacctggacctgaaatttattagactcacgcgagcccctccctcaccctcaacgacgccaattgcccccatagggggtacctagcgtcaatttaggggggggggggcactgggtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcgtcacagtgtggcacctagtgggccagctagtgcgctgtagtgctatccctagtgctatccctagtatgcactaggctatccactggctatctttagtgctttacattgtgccgattctatgctacgctgcgcgctccccactagggcgcacttccactacccggcacactccagcgctatccagcgctatccagcgctatcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggccggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggtgtagactaccctcacaatgagggtccactgcaggcacttatgggtctacgtactgtcggcatgtacacctcgggtttagaggtaactataggcgggatactgcacccaaaataccgcgaggtgatgagggttagtgggccgttgcaaaaggtggacttgtaccggtccggaactttctacgaactcctttctccggcgcgaatcaccatcgacagcaagttctgggaacgccgccgcgacttctatgagggtgatgatgtagtggttgagcgcgtggttgcgtgcgtggaagagttcaccggctacaaggtgcacaagcaggccgtgcagttattcgagcgcattatgcttgcaccagaagagcggcagcgccgggagtacactggctacaattacggacgccacatccgtgacatgagcgccgcggcgctgctcatgaagttgcacggtttcgtagtgtctagattcgccgtgcctttgggctttggtttccgcaacggtgagcccatcgtgatgctggggcagcctcgaatgcacaaggacttcgccgcagttactgagtaccgctgcgtagagatgcgcgtaggtaagtggctcgctaactactacggaaatggtgtggacttccgcgatgctatcgaagacctcaaggctatgaacgtagaccctaaaacgtacctgtgcaagaccgagcaggaatggtacgacgcctacgagaacggcccgggtagctgcatgagcgggtactcctttgagcatagccctgtgcgggcgtacgctactaccagtcacgggctgccggataatgggctgcgcctgttcatccagtacaccggggagctgttcggtgacgacttcgaagtgcaggcgcgagcaatcgtgaggccagaaactaacgagtatgttcgtgcttatggcaacgctgcggatgcaatcctgcgcggacatgggtacatcagaaacactgagtgtctcgaaggggtaatgctggcgcgtataccacacccgcaacacaccggtgcggtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagaaggggtagtgcatgaccaagaagaactggtgtttgcacaggaccggcaggtgcttattgagcacgcagaagaacatccagtgcacgggctaattctcactgaatatgcagccgattgcttgggagagaagtatctgggcaacgacgatgaagaagaagtagaggaggcagcttaatgttcttgaatcctcacgggattgatatgcagctgctcttgcagatactgcaaacgcaccggcctagctgggcaagtaccaagtggttcgagccgctgcttatgcaggcgcttggtagtggtatgcactacgtaaaggacaagcacggaaactacttcgtgctggtgggggactcagagcaaagcgacgtggcatttacgtcgcacctcgatacggtggcccgtccaaccagcgctgcgccggacgtcggctgcactaacaagggtgttctgttcgtaaagaatccgcagcaggctgactgcttaggcgcagactgcggagccggtatctacctgatgctggagatgctgcgacggggcgtgcacggacgctactgcttcttcgtggatgaagaggttggctgcgaaggcagcgctgcatcggtcaatgatgacactgggttttggactggggtcaaggcgatgattagctttgaccggcgcggcgacggaatcattacgcaccaacggtacatgcgctgctgctctgatacctttgccaagatcctagcagagcgcctgggacgcacggagcagcacttacagaagggggtgtacactgactcagccgagttcgttggtatcattcctgagtgcaccaacgtaggtgtagggtacatgcacgagcacaccccggatgaggtactggacctgaacatcctggggcaagtgcttgagcgggtactgcaagatggtacgttctcgcacctaccgattgagcgagacccgaaggtaatggagccagaccaatggctctctgcaccaacgctcagttcacggcagccgtgggacatgcccccggacgaggacccgcaattactggccgcgttccgggaagtgtcacagctatctaaacagcaattggttagctgggtgcaggagaacccagagaaggcggcggagtacatcatggtgttctccgattatggcttcaaacaggagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctatatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcctgggaatactattgccaccgctgcaagcaagtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacagcaaccgaagtgggtaatgtacggccagccaataccgttcgctgccgcggcacctgccgcagcaccggctgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccatggataatgaccaagcgggacactccggcgcggccatgatacgccgtgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacctctgcatagaaaggtgtgttgctcggcgaacgatatatctccggagagcatagcggggctagttgtgcgccataagtgtgacaacccgagatgtattaatcccgagcatttagaattaggtacggtcaaggataacgtccatgactgtattgccaggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggatctaatagttgtgcgtgcaatgtgcacgcagaaggtgtggaaccggctgcgagagcagatacccaagtctatgcttgcgccggacacttcgaaccttctggactgggtggggttgtactggaacacttacccggagcaccaggaggtgcaatgggatgcgatgcagagcatgctcaacctccgggcggggcacttgtcccgggaagagagggtaatcatggacgagcttatgcggggagtacaagccgtgccgcaggattctgtggtgggcattgtccagaccctgaatgagctggcctacagcggggaggtagcagcgctgacgcagcgctaccaagatggcgaggaggttgattaccttctggagatgaagcacttgcagcgcaagtacggggacggcgctgctgttcatgattcgctgcttgaatgggagagcggaagtgttgatgaaatacttgccgcgactgacgagagcggcggtcttaaactgggcgtgttcgagcaactcgctagcagcatccgaggcttacgcggcggggactgcatcgcagtggctgctcctgtggactctggtaaaactagcctgcttgctgctattgctgtggactttgctgagcagatgcagcagcagccggaagtatacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgcgcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcgggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatgggttaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgagcagggttgcgagttattatcttgacggggcgctctgatatagtacgagcggaaacagaggcctggctggagcggaacttcgttatgtactccgagctggttatgaggccgcacagtgacaaccgaaaggatgtcattatcaaagaggagttcctgcgcaaccaagtggggttagaaaacattgtggcggcttgggatgacagccccgcggtgattgagcatttccgcggactgggtattaccacttacgctgtatgcgactatggtgcagcagcacatcgaacagacttaaaatcccacggggtggaggaattagcatgagtgcagtaggtacaggcatgaagtatgacgcagacaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacggcacatgctctgggggaaacactggactcggagagcgggttgccgcacctggcgcatgccgcttgttgtgcattatttattctagaactggagcagatggatagtgcggccgagtgagtggtgccacgggatgtggcagaaagcagtagagcggggcgacgaaagctccgctaaagactacctggagatgtataatctctgggtcagccgcaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgggcacgtaagctgattacggacgcattgcagaatggtgggattatgaacctgccgatgacgcagcgtatgctcacctctgcatatgaggtggctgctgcagctatcgatgagatgcgaaatgtcaaagccccaggcattggtgggaagtaccgtcggttcctgcgcttaatccccttggatgtcctgaccaccctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagccccagcgtacatggaccgagtatatgagtatctcacagagcgccgtacgaagtcccctacgcacatcctgcgtacgctccgtgccagtgccgagaacgtacactatgggcacgagccttggaccaatgcccagaacatctccgtagggcgtctgctgtgtgccgcagtgtttgagacgggactgttccagtggaagaactgtagcgggaatctgagcatgctctatccggctgacgacgttatggaggccttccagaaactggtagagtccgctgataccgtaaccatgaagccacctatgctggtaccgccggtgcagcacactactctgtgggatggtggatatctcacccctatcgacaatcgcggcacctatcataattctcatatcgaccgcgcacgtctccgtgaagtagcggaagcatttaaatccgcggatggcatcaaaaaggcgcttaataaggcacaggaaaccccgtaccgtattaataagcgcatactggaactggtgcaagaagcacgggccctgggtgttgggataggtatgcctcgctcagtaccggagcctaaaccggagtggtatctggacggggttcctaaagagaactacacagaggaagagcttgaccgcttcggtgagtggaagacgcgtatgtccctgtggtacagtgctgaccgtaagcgcgtatcgcaactacgcagccttctgactacgttggagatggcagaggaattcaaagatgagaaagccctgtacttcccgacttgtgtggactggcgctaccgcctgtacttcaagtcctcgctgcacccccaaggttctgatttgcagaaagccctacttgaattcggacgtggtaagccgctgggggagcgtggcctattttggctcaaagtgcacgtcgctacatgctttggttatgacaaaaccctatccgaagaccgtgcagcttgggctgatgcgaactttgcagagattgagcaactcacaatctctccgtttgattgccctgcttttgccaaggcggactccccctggtgtttcttggccgccgctatcgacctggttaatgctattcgttctggatgcccagaagagtatattagccgaatcccagtagctatggacgctacgaactcaggtgggcagcacctctcagcgctcctgagagaccctgtgggcggtcgtctgacgaacctgtactgggagggtaacgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctagccccgcgtatgcgcgccgctatagaggaggcaaaccctgctgctgcggcagttatgtcgtacttgcagaacctcgctaggcgtgtaccggcaagccagcacctgcagtggtatacgccgctgggcgggctcgtaatgaaccgctacacacagcgtgaagaagtgcgggtacgaattgactgtatgaacctcacaatcatgcgcgtgcataatcgggatttcaagacctgtaacaagcgcaaggcagcctcggggattgccccgaactttgtgcacagcctggatagtacgcacttgatgatggttctatgtgccgccgagggtctggacattgtgccgattcacgactccctggctacacacgcagccgatgttgatactatgcaccggcacatccgcgagcagtttgtgcgtctctacgaagagcatgaccttcttggggatatcacccgcgcggcggcagcagctggtgcggacttgacggacctggatatgccagaggttggtactctggacatccggcaggtactggaatcacctttcttcttctgctgagggtatggtatgcgagtactagtaactggtgggcgagattacacagactacttagcactaaagaccgcaatggatatgctgccaaacaaaccatctgtagtgatacatggaaatgccagaggggcggacgcactggcagacaggtgggccctggaatccggtatttttgttctgcgtatgcctgccctgtgggatgtgcagggtaaatctgcaggtatgcgcaggaacgccgccatgatatccttggcctttccagaatactgcgtcgcctttcctggtggaaggggtaccgctggtatggttgagttatgtagaaaggccggtataccagtttgggtaccctactaaaatttaatgttaccggagtaggaatgaagttaaaacacactggtaaaacttccgattacactctcaaggttctgtataagtctgacgatattacagacgcagtgaagcaactgcacgaactgggccacggcattagtcggggcctggctcctgagcagcactactggagggtgttgggaagtatactgggtaaacagtatatactaggagtctatgactcccaaggcgacttagtcggtgccgtcagctactacccagaggctgtagaggactgtcattacgtagagcctgtgctatatacagacttcttcgtattgaaaccggacaacggcgcggcagtgtctgtgattatgcagggcctgcacgcaatagccaagtgcatgcgcgctgggcgtatcgccattagccggagcacgtctagtaacacgtacaaaacaacttatcatttagtgaggtcagaatgagtggtggtttaggtaaactgttaggcaaggccacggatatgctcggccttactgacaacgcaggattagaggcgcagcagcgcttggcagagcaacaggccagcgcagctaaacaacaggctgccttagaggctaatagcgccgcagataacattgctgagattgaccccgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcacgatctttacccgggacgattccctggacggtagacgcaggccgctggagcgagactatcagagcaccggcgcgcagctggtcaacactgcagccactaagattgtaggggccctgttcccacagggcaccagcttcttccggttctccaagagttcggacctggacgagttcattagttcgctgggcagcgcagctacagcagaatctaagctggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgtccaggacctgccagaagatttccgcggcaccttctaccgtgacaaagacccatacggcgacgttgatatctacactgccgcttgtcgcaaggttaagcggacagaggaaggcgtagaagtagtaagctacgaggtgtaccaagaagcagacgggcaccgtatcggagacagcagcacctatccagagctggagcttccttacaacgtgctggtgtggaaccttgttagcggcgaacactatgggcgcggcttggtagaggactacgccggggacttcgcccgattatcagtactgtcggaagcgttgactaactacgaggttgagtctgcgaggttaatcccgctgattgacgcaagctctgggttagacgtggacgagttctcaacgtcggagacgggtgaggctgtgcaggtgggtggtggcggttccaacgggaacagcaaatcccccgtcactgcttacgagggcggctctgcccagaagattcagtggattgccagcaacatccagatgctcgaacagaaactgtcacgtgcgttcatgtacaccggtaactcccggcagggcgagcgcgtcacggcctacgagattcgccagaatgccaaggaggcggaagccgctatgggcggcgggttcagtattctgagcgacacatggctgcgtaagctggcgtacctgtacaccgcactggtgtatcctcgctttaagctgtacctcagcgaaggtgtagtgagcatcaacgttacggtgggcacctctgcactcgctaaagccgcggcagcggacaagctgttagaggcggcgcaatccatgcagctggctatcccggtgcttgagcagattactccgcgcttcaacaaagatgcgtgcgtagattggtacttcgacgcctacggtatcgttagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctccccttagcgccccgaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggtaaggccctggagtatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatatcgtgggcggtaaggagaactgggaggtagcagcgcagctgtttaattccaaggcccctgaacctcttcgtaacgcggctcgtgcactcgctaactcgggtgagctcaagcaggccgctgagttggtggcaagcttctgccgggatatgggtcttatcaagacacagaacccaatggtacgcggtgtagccagcaacaatgcactatctgctgcggaattccgcgcagaatataccaaactccgtcaggaagcgggcaaccgtagcttggcgtctccacagttcagtcaacgttataacgatttgctcgcacgccgtgaagctggtaagcgcgtaggtctttaattttatttataaaggaaactaaagcatggccaacactatttataatggcaacctgacccgggcccactggggcggcgcggcgtctgacgtagatattcacctggaagtgtaccagaacgaagtggatacccgcttccagtaccaggctctgttcctgggcctctccagccagcgctctatcagcggttccaacacctaccgtattgaccgcctgaacacctcctcggtgaagggtcgtcgctctggtgaggcgctggatagcaccccggtccgtaacgataagatgattatcgtggtggatacggtgctgtatatccgtaacccgattgactaccaggacgactggaccggtccggacttcctgaccgagatgggccagaacaacggctccgagttcgcagagacattcgaccaggcgcacctgattcagctaatcaagggccgttcctgggttgctccggcgcacctgaaaccggcgttcaacgacggtattgaggtgggcgctgctatcctggttcctggcaccactaccgccacacagctgacccaggctgagatggaggctaacgccatgaacatcaacctggcccacaaggctggtattgatgaactcatcaagcgcaagaccccgctgtcggacatgattaccctggtggatgtcgatacctattcgcgtctgctggagcatccgaagctcctgaacctggaatttggcgcatccaacaacgacggttacaaagaccgccgtgtagttaagatgaacggcgtgcctgtggttgagtgcaccgagttcccaaccgaggccggtacgcacccgctgggtagcgcctacaccgtcacctctgacgatgcgctgtgccgcatggtgactttcagcaagtccaagaccctggtgactgttgaggctaagccgttcacctcccgtatctgggacgatgagcgtgagttcagcaacgtgctggactgctacgcgatgtacaacatcggcctgcgtcgtccggacaccgctgcagtgaccaagttcaccttcaccaccaagtcctaattggaggttcaatggcagtaatcgctacgttcggtctggagactctccaggccaatgcagctcagcgggaggcggttaaggccgccaccgatgtagctaagaacatccaggtggcttcggttgaatctggccgcaaggctaccaagaaaacccgtaaggcggctgacgtagccgctgatactgcggaagagtaatacgcgcccctggtgccttcgggtgccaggggctttttttttgtccctgtcttaaaggtccaaggggtctttaatagaggaacaaatatgagagaattagacgctgttaacctgacgctggaagcccttggggagtctcgcgttatggacatcaacactagtaaccctagcgctggattagctcgctctgcactcgcacgtaaccgtcgtgggttactcagcacgggattctggtttaacgtggtagagcgtgaagttacgcccaccaccgacggcctgattaaggtgccatggaaccagctggctgtatatgacgcctgctcagaatccaagtacggggtacgtgacgggaatctatacgacctggtagagcagaaccaatacttcgatgcacctgtgcgtattcgtgtggtcctggatttggcctttgaggacctgccggagcacgccgctatgtgggtggctaactacaccactgcgcaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgtgctcgttttatggtttaaggagagtatatggcccagtccctagagggtaccattcagagcctgctgcagggcgtctcccagcaggttccaagagagcgccagcccgggcaactgggggcgcagctgaatatgctcagcgacccggtttcaggtatccgccgtaggccgccgggtgagattgtctgggaaagcacaatcgatagccctgggcttgattccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagcattgccgggctgacttatatcctgaatacggagatggccccgaacacaaccgtggacaatactgggcgcatcgaccccagcaccaccgggttcttctacgttaaatccgcagcattccagaaacgctggaacgtcaccgttacctctgcgggggtggactacactggggactacaccgcaccggctgctggcagcacgagcggtaacgctgaggaggtatcaggtgcctacgttgcccagcagctgcgggactctcttgtagcgaacgggctgccctccgggaacgtgagcgtacgtggtgcgtacctgttcttctacgggttgagcaactgcgtggtatcctctgacgcgggtgatacttatgccgtggtatccaaccagtcacgtgtagaccaggagcaggaccttcctgcacagctcccggcgcaagctgacggggcaatgtgccgtgtaggtacagcctcgtctgagacggcgtggtatcagttcagctacagcacccgcacctggtccgaggtgggggcgtacgatagcatcaccaagattacgaacatgcccagagagctcgccgcggatgacaacatcattgcgcgggattgggaggggcgcttagctggtaacgacgataacaacagtaatccaggattcgtcgagaatggctacatcactggtattgcagctttccagggccgcctggtcctgcttagtggtagctctgtggatatgtccgcctcgggcctgtatcagcgattctaccgctctactgtgacgtcactgctggatacggaccgtatcagcattagctctgcgtctgcccaggattctgtgtaccgcaccgctgtgcagttcaaccgggacttggtcctatttgctaacagcatgcaggcggttgtgccgggttcggcagtacttacgccaactaacgcaagcattagtattaccagcacctacgattgtgacagccgtgtgactccggtaatggcggggcagacagtaatctacccgaacaagcgcaacgacagctacgcgggtatattggagctaatcccatcaccttacaccgcggcacagtacactacgcaggatgccacggtgcacctacctcggtatatccccggtagggtgttgcagatgcaaaactccagcgtcaccaatatggccttctcgcgcatgtctggagagcgtaacagcctgctggtctacgagttcatgtggggcggaagtgacggcgctaagatgcaggcggcgtggcataagtggtcgttcccgtacccaatcctgagcgtacaggcgctggaggatgaggtgttcttgtacatgcaagggcccagtcccagcaacaagcttttgattgtgtctatggacccgcgcgaaggttatcagctgggctcagagtaccgcgaagcctactcggatttgcagaagcaagttcaagtgcaggacggggtgttcactgtcccgtcggtattgcgcccggttgggtgggcggacaactacaaggaagagcttatcctaacgtacctacccagcaaccctatggggcctactgaggttggcatcaaggagattgctggggagaacaccctacgggttgtgcgcggtgtacctgatggcacttatgtaatcgggagacgttaccgtagtacgttcacgctaactacgcctattctacgggaccagaatgacaagctcgtgggaagtgggcatgtgcgcctgctgcgcctggacgtggcagtacgtaactccgggcacttcgacgtacaggtactagacaccccgcgggacgtcaattggggtggggaactgactggtatcttgatgaactcaaaggagctgacgcttgggcaggccctgcgtatggacctggctacgattaccgtaccatgccgcactaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactgcaggcagcagcttccggcactatgggagcctctgttaaagacgcagtagccacggtgaacactgtagccgggcggcaagaggccagcgtgcgtgaccagcaggcaactcaggaagagggcttccgtctaatgacagataaggccgtggatagcggcctggctaacatggacatggaggacccctacgataacatgtttaactcgttgttgagtgtcggggcatctgccgttgggcagtacgctggtaacgctgcgtcgtctactgactctggtagctcttcgcctggtagcggagcgtcagctacgcagagcatggcatcctcctatgacttatgggggagtaagggcaatagcccagttcacacctggtaaattaggaggaatactaaatgcctgtgattcaacccagtagacaggggttaaatatcggtggcgtgcaactgcaatccaacgatgttagcttgccgtcaacggtaagtgaagtatctgttgatacctccaaagcaaaacgcctagccgccctgtctggattcgtgcaggacttcggcgtaggtttcgacgcggcagtaaaagaaaacgccgcagccgccaccgtgcgcggcgctatggatgctcagggcgcagtagatgcaatggcctccaaggacgaggctgtacagaagcaaaacatcttcgtgcgcgaagcctatcaggacggctacgtatccgccgcagcgtacgacactctagctaagtggcgcacagacagcatagcccgggctaagaaagctgccgaggcagggctgactgacgaggaattccagcagcaggagcaagagcacgtacagtcaatggcagacaagctcggggtgtatctcccggatatgtccaagcagtctgctacgagtatactgcagcagctccgcgctaccagcatggctaactatacagccttccagaaaggacgtgctgcgttcgccctggcccaggctgaccgtgccctagaccgtggactgagtgcgtccagcgatgagttctatcagcgtctgcaggcaggacagggtgccgccgcgcagatgtctatcaagaccggattagacagtatcctggctgccgagcacttggacaagaacaagaagctggacagagccaagcagtatctggttagcgtagcgcagcagacgcaggacccactggtaattaaccagctgcaggaaatggccaccaaggaactcggcgtcaactccgtggatgtcaacgcggcactgtatcaggagttcaagcgcgcaggtgctcagattgagacacaggcccgtttcgaaatctctgatgcaatacagtctcttgaggggcagacacctgagcagcaagaacagactatgcagcgtattcgtagtcgtgtcattgagctgtcggcatctgatgtacttagcgccgggaccagcatggagttctggaacaaagcccagaccattcgagagaaggcagcagacgcccaagcattgcgcacagcaattactgggaatatgccaagctctactctggcgggcatgttcaaaggggacttagataaggcacgtactcagctgctcaagagctttccggatacccccgaagggaacctgcagctgctggcatacggaagcaacagcaaggatgcgtgggccgtaaacgaggcgcacaagcgtatgtcttcggatatggcacgtacgctgactacgctggaccagctcggtgaagatggcgaggtttcccgcgagaacgtcaatagcatcaacttgtgggcacaggcttatagcaccagtacggacttagggaagatggcgctgctgtctgaggtcccatctgagtggcgtggagtggtgcagaaagctgttacgcaaaacccaaataatgccagtaacactatcttggacgatcttcgccgccaggctcgtaataaggcgagtgggcgctacagcaatatccaaagtaaccccacggacaagatggtagacccaagcggcacggctaactggttcagcttcttcggggatgcagacgcacagcgccaggaagcgcgagctgctatggaagatgagtaccgttatgtgtataaccacaatccggaatcccttgtagggaaggacgctgacgacatcaatacgatgctaaaaggcaatatccaatcccgtaagctggagctggacattgccggggcacctaggcatgtgtatctgcccgctggcacctctatgcaatctatcatgggtgattataagggcgaccaagagcagttcaaggcctccctgcagcagcatatacagaaccaggttcagtatatgtcagaccccagcaacatagagcgtgtagtagtgcaggccgccaccgctggcaacgcaggtcagaacatgaccgtaaccgtgttcgacaagaagggcaccttccagacgatgtctgtgaaccttcgagacgttcagacgactgcgcaggctgcgtatgactcagcactggctggagagatgaagattggaagcgagcaagtaggtgtacgtcctgccaccttctacgaccacgacaacgggcgtgccgtcagcgtacaagtaaatggccgtaactcggtagggctggaaccatcactgtttagtgacatcctagccactactatgaagttcgaagggttccgagaaggcaagggtaagggtagcgtaggcttcggcctgcacgttaactctggcatgcccgtcccccagaaagttaccattgacgacggtatcagtatcctcaaatcctcactggaggagcagtacataccgaacgtgcagaagcaactcaagggacagggtttgactgcctccgacgaggcgttaaaggttatggtggacctgaactatcacggtggtaacggtagctccggccccgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgggcgtaagaagtacctggaacaaaacctacgtgattggctcttcgaagcaacgcactaaccagaggcccttcggggcctccccttatcaaaattcttttaggagatattatggctcagtttctgaaccaagaaccgaatccacaggaaaaggattctgctaagggcgcaacacttaaatctgcgcctgagcgcgtagattggaacgatgccggggacaacggtctgaacgcactggggcgtgcctcattactggcacaggccaagaccccagctactacagccgcagagagctttgcctcgggtatgggcaacagcatcatcgccgcagctatacgcaaggcctctgccccggcatttgaccgagacccgaactttaatgccaagcagaccctgagtagcgatactcgggctaagctgtacgccccaaatcaggaagagattgagtacctgcatgactccgtgtcagtagaagattacaactaccgcatgcagcagatgcttgagcagcgtgaccgtgaccgcttaatggctgacaacacagtagctgggttcgcgggtatgttggtaggggattccccgttcatcctggccccgatgtctgctgctggtattgctggccgtgcgggcttagctgcacgtaccgctatacgcgctgctgatgtaggtactgcattctatgcacaggaccaactggggcagtctgctgcggtaactgcactgatagcgggcgtagctgggttagaccagctctgggatatgtctagggctgctaaagctgccgccaaggctcgtactgggcgtgagcctatgttcgacccagaagcgcctacaactcgtacagctagggatgctaatgttaccggagtaggagagggagaggaaattctcactaagacactggatgaaagcatccaagtatcgagaaacaataccgcctccgtgaacatgaaagcacagcacgtagttcagttcttgaggaagtctgagcacttgacagcaggacagaaggctattctggacacgctgggcgatgctgtaaatgacattgattttaaactagtagcaggctccgcaaaccgcagccgctacacttatgcacaacaagatttagctaagcggggagagatatccctgcgcgcgcctaagcaagctaacggcagcacctggactacagtcggtgatgcgctgcgcgctatggatgcagatacaagcaaggtggccgtgcacgaactgattcatgccgctactgcgcgcgctattgacagtaatcccgagattgctaaacgcctggaggaagtgcgcgctgttattgcggctgattccaccctgacaccgcgtatgcgatattacgcaagtaatgtgcacgagatgctggcaggcttaggcgacagccctgagtgggttgagcacctggcacgtacgcagtctcccaccggcaatagcatgctccgccaactgggtgagtacatcatgaacgctctgggcatcaaggccaaaggctctgccttggaggatgtactggatgcgtatgaggatgcagttaagtggacagctaaggattatgcagaccaagcccagagcttccgtagtgaggctttccaggacctggcgggcagcactaccctcaacgaggctaagcgtgcacaagctatgctggacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgcccgcgccagcgtagttgaagatgctatcctaggcgcgttgaaggataagggtgtaggggtgctctcacgcttcttccatcggagtaatttccgcgctgagcgggctgcgctggaggaccgcctgagcaagtacctggatgctgcctacagtgctgacgtaaacggccgcgctgtgccggtgccggatgcagagattgctccgctggttgatgcttaccgccgctctggctgggctagcaagtggcacgagcatatgctcaatgccggtctagtggatgatggtgcgttggttaaatccgactactacttcccgcgccagtacagctacgacaagatgcgccaaggtatcgcgcagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatcccctgcgcggaacctgcgtcagcgtactcggttcaacatggacaaagagtacctgattaacggaaagagcatgcgtatgcaggacctgatggatactgacgtagccaaggttatgcacgggtacactaaccgtatgtctgggcgtgtcggtatggcctatgcaggcgtacaggacctggggcagctcgctaagatgattgacgagtccaagcacgtactggcagattctgctaagtgggagaagaccgtcaatgacaccatcgactttatcctgggtggggcacctgctgacgctgggcagcttccggacttgctgcgcgcagccgggaacatggctaacgccactatgctcaagaactccggcctgtatcagctgaccgacactgcgttggctatgaaggagtttggtatggcccgtgtgctgcgcagtatgcgagaccaaccttggttcaaggaaggtgccgtagctatcaagactccggatatggctgcccgcctagacactgtgctgaggggaaatatccagaaggagatgcgcttccgctggctgaatacgtacgctgacgataacctggacctgacccgtcaggcctcctggttcaacgtcactcagaacgttgggcaggctgcacgccacgtcaacggtatgagcatggtgcatcggctgcaggttaacctgaactccggtattgtggcggacgagcttacgcagatgttcaagggtgatgctgaggcgtttaagcgtctggagcgtttcgggcttacccgagatgttgcggaccgcgctatcgctgccaataaggctaacccgggcgccatgttccagccggacctgcagatgcaagttgaggttgtaggggcgcgtatgatggactacctggtacagcagattcgtactggagagacctcacactttgcacagttcaaccctatcggcaaagtcatcgtagggtaccagagcttcgcactggctgccactaacaagattctgcgtagagagctgaacgatgctgggtggattggtgtagcccacattatggcataccagttcccgttgatgctgctggctactatggctaagcatggcatggatgggaaggacgtagacacccagaaactcatcagtgagtccgtaacgggtatgagtgccatcggcggggtatccttactgcaggatatcttcctgggggattctccccgccactcgttggcgtctatgggttatgtcacagggctgctcggggccgtacaggacctggctactggtaatatggacatcaagaccttcactaagcaggtaccgttaatccaggaattcgcacctacgcgagctatcatcaataacttcggagacgattaatatggcgttcagctggcaagaacaaatcaagccagctggtacccaggatatccagtgcgatattgagtatttggacaagtcctatattcatgtatacctagacggagaggaaaccactgggtacacctggaccagctctactaatatcaggctgaacacagccttaacggcggacactacggtgctgctcattcgcaagactgagcgggagtacttgtatattgagttcgccagcggctctccgttcattgag

SEQ ID NO: 166 - DNA, 43409 bp, Unknown
  source: /note="Description of Unknown: Mcoc3c Bacteriophage Sequence"
tgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccggatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcagaggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcgaatccggtagcacatcccctgcgcggaatctgcgtcagcgtactcggttcaacatggacaaagagtatctggtgaacggtaagagcatgcgcatgcaggacctggtggatactgatgtagccaaggttatgcacgggtacactaaccgtatgtctgggcgtgtaggcatggcctatgcaggcgtacaggacctgggacagctcgctaagatgattgatgagtctaagcgcgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcgagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaatgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacaggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacaggggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaaagtctgccgacgctatcctggatacccgagtaactaatctagagcaggcctttatatccgacagggtcactgtaagctacccttggtttacagtactggatacccccacagacaccgtgacgccgcccatcgcttttagtaaggccatagttgagctgaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggcctcagtaggcgaactggcgtacaagggcccggcaaacgctgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagaccgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacattgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccctactcgtggggaccgtacttcattcgaaggctacgatgtcaactgcgacctgaaaccgctggataaatccgccagcgtagcctgtgtaggtatcactgcatccctgcaggggaagcgcgcggacctgctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatgggtgagcgatatggaagtacacttgctccttatatcctggagcttattgagcgcggctataaacgcaccggcttcggcgtcgacgggacgctaggcgagagcacggacaccggacgctatgacgaggatgcactgattgagaaggagctggacttcggtccggaaggcttccagctgcagtacatgctcgacactacgctgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatcccggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgtaatcgctatgatggtggctacgctgaacgggcacctggtggaagatgagaaagtggtggctgagcgtgagtctgagaagatggctcgggccttcattgagaacccgctggattgggcacagagcaaagtgtctaagggccttcggggtgtggctgctaggttgcagaaccgtggcagaggtaaacaacatagaggaagaagataatggcatttgcagaagcaacactggcacagcgccaggcagtacgtaatgcggcagtggcgcttgataaagcaacaaccttggcgcatgataccggcccactagatactctgggtcctgatgcagatgcagcaggggctgtagcagtggcggcactctctgctgcaggagcctctgacggtggtgctgtagtggtggttggtaacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcaccggtacaatccaggcagggcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtatcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcagatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacacttagcctggatggtattacagtagagcgtgctcgttctgttccatttagctttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagctcctacaaagttactctgtttaatcctggggctgcggcaattacccctggggctactcgggctcgcttggtgctgcacttctaacgcacagcgtaaagcccaggcccagtctaggcgagcagatctatacctggacctgaaatttattagactcacgcgagcccctccctcaccctcaacgacgccaattgcccccataggggggtacctagcgtcaatttagggggggggcactgagttggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccatagggacgtgctctgccttgcttattttgtgcctgtccagcggggccagtagtggggccatagtgggccagctagtgcgctgtagtgctgtccctagtgctatccctagtatgcactaggctatccactggctatccttagtgctttacattgcgcggattctgtgctacgctgcgcgctccccactagggcgcacatccactatcccagcgctatccctttgctcttactttcattcgaaagctattatgaaatgaagtaaccggagtaggaggggtttagggcactatatacactactactcactagtactcactagtaatgccctgtatgaccgaccgtagggagggaagcattaactacgctacactacgttccttcacttacgttacgtcactacgctacgctctatgcagtactatgcagtatggttagtagtggttagagtacccctagagctatccctagtgtggttctaagtgcagctctaagtatttgccctgcttaccctttttgctcttagtgataaaaagttgaaaatattacttgcttcttttggttcaatggggctatagttcaatcaccgggaggcgctgaggtgctgaacggagccgagccgggaggctccgccggattaaggctagatagtgtgaagggttagacactcgataaaaagagttgacaccgcgaagaacataagctagattgaatcccaaagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattaactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactgtgcgtcttgactacaaacaagctgacaagcaggaccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcgggtatacgcagaatacaactacactgtggtcatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctgtagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgtaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaggacctcaaggctatgaacgtagaccatacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctgcaacggcgcagtgctgatgccatatctcgatagcagccagtgtggcgtagacgaagaaggcagtgacgcctttgtaatacgtgacgactacgagtacgaggcgcaagactcagaagggtacatctacgtcggcacagaatctgctcggtgctgctgctgcggggggcgctactccgttgatgatatgcacgaaaccgccgattatgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagagggggtagtgcatgaccaagaagaactggtgtatgcacaggaccgacaggtgcttattgagcacgcagaagaacaccctgtgcacgggttgattctcactgagtatgcagccgattgcttgggggagaagtatctgggcaacgacgatgaagacatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggcgcgcccaaccagcgctgcaccggacgtcggctgcactaacaagggcgtgctgttcgtaaagaatccgcaacaagctgactgcttgggggcggactgcggtgctggtatctacctgatgctggagatgctgaggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgccctcagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctgatcacaaagggaatcatgcctgaaatggtgggggatgcagaatggagcaaagagaaacagcggataatcttccgtgtcggaagcgctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctgcgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacgtccatgactgtattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggtggtcttaaactgggcgtgttcgagcaactcgctagcaacatccgaggtctacgtggcggggactgtatcgcagtggctgcccctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcactggactctggctgagattaaggaccggcacagtaagcaagagttcgtgccagcctacctcaagaaagtaggcagggctgaccggattcgtgtcaaggctgcgcactccttgacgatggcccagatatccacgctcatggaggagatgcgccccgcggtaatcatcatcgacatggtggctaacatccgtggtggcactatggagaccgagcaccagaacctcgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgctgatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagtggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgacaggttgtattgaccacggacagaggggaagcacttgccgaggaaagggcgctgggtatggccgctccagatttgacgggaagacaactggcggccaccgcaaagcatactgtatagcccacaacttgaagctgagcgatatcgcaggacttgtagtccggcattcgtgcgacaatcctcggtgcataaatccggagcacctgctactagggactcctagcgataatatgcaggaccgaaataaaggtgcgcgtaatttgctgggcagccgcaaccctgctgccagacttaccccagaagacgtgcacagcatacgagaagcatacgctggcggtgagacccagatatctatagcgagacgcttcgggacaagtcaaggatacatatctaatatcataaaggggagggtatggaatgagcagaagcatcctgataacggattatgagacgcaaaaccacccatattacggtagtgttgcttccccgtactgtccggataattacatcgtagaatcagcgtggcgtattgaccgcacgcacgatgacggtacggtagaagtaggccccgtagagagtgtacggtataacagtcgcgcgcactttgaagcggcacctgtatcagaatggctcccaataccagctgactgttggctgattgtggctcacaacgccgcatatgagattagctggttcctaacctttgcgcgcgccgagtttgaggccttcctaaagcggggaggtcgcgtattctgtacgatgcattctgaatacatcgcctcggactttcagagcatgtatccgtcgctggacgagacggctcctaagtacggtggtacgcacaaagtagacggggttaagcttctgtgggagcagggtgtgctaacctcccagattgacccgatgctactgcacgactacctggttaacggggacatcccgaacacggccctgtgcttctacggccagtgcgctacgttcgcccagcgcaatcagatgcagtacgtgtgggagcgcatggatgccttgctggcttgggcgtactgcgaatggttcggcctgttcgtgaatatgccgattgctcgcaagaaccaagaagagcaggagcagcgcatcctggagattaagcaggagctgcagcagtacatcccgaaggacttgccggagacgctggatttcaacttcggttcggacttccatatgtctgcactggtgtacggcggacctatcaagtaccgcaagaaggttccatatttccccccgcagtatgtcaaggcagactattggcaagtcggggacacttgggttgccgtggacgacatgcccgcgccacccggtgcaaccacgtacaagtccggtaagaacaaggggctgccaaaagtattccgccttgatacagaggaggagaaacttaagtgggaggatgacctttacttctgtccgggcctagtggacatccaggagcttccggaagttatccgggagaagtacgcagagcgcggagagttccggcaggcgcgtaccctgcatgacggcacgccagtatacagcaccagcactgacgcaatggaggcactggctcgccaagggttcgagttctgtaagttggtaaacgagctggcggcgcttgagaaggacactggtacttactatttgcgggaagttctggatgcaaacggagaagtcaaagagcggaagggaatgctacagtacgtaatccctgaacgtcctgatggttccggaatcatacaccaccgcctgaatacctgtgccaccgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcctgctacaggcaggtacggatatgcactgttaccgcctagctttccgtgaaggattaccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtgcacgatgcgctgtacctggacagcgccaacccagaggttggacgtgaggcgagcttgctggttaagcagtgcatggaggacgcacctaagcgtatccaccagctctggcctaactacggtatcattggtgaggtcccgttcccagcagaggctgagatgggtacgagtatgtacagtaaggagaaggtagaatgagtataaagtcaggcagtgttgtggagttgatggatcttgggcctgagccgatagacccgaggtatgcagcatacttcaccccaggtacaaggcacacggttatattcttcgacccggttactggtgagatagaactaagttaccctggactgttagtaagtaggcccggggacggcgtcaccttcttccccggggagtacaagcttatcgaagagtagtgataggtgtacccttgggtggtgtagggggttagggtagcatggaaatatgctagggtcaactaaataattaaataaaattatttgttgactttggcttgattctgtgattcccctagaattaatgtgatacgagtaggaacaacacaagagaggcaataatggcacgtgttagcctaataaaactattcaccaaagagcagcaccaggcaatcctgggccagtacctagacaacgctctggctgctcagtactacaaccaagagctggataatcgcggggatgtggacacggacattagtgtatctcgtcagcttgtgcgctattggcgcagcatcttcatggataacaagggcagcaaggcaagggctaataatgctttgatgcaagcccgcaaactaatccagccctccccaacggatgacattggggatacgtttgtaccggaaacctgtcgacgtattctcgttatcggggacctgcacgagccgtacacacatccggacgcgtacgactttttgcgcactgtacgggacgagtactgcccagacattgttgtgcagataggcgatgagacggatgggcacgccattagctttcacgacagcagtccggagttggatagtgctggggtggagttagagaaggccaagcttggcctggagcggctgcataacctgtttcctaacctgctcctgtgcgactctaaccacggctctcttgtctaccgcagagccaaagctcatggactccctgtacagttcattaagaagtaccgggacatcctgttcccagagcatggggcccccgggtggagttggggcgatgcttgggatttgaatactccactgggtattgtgcgattccaacatcaagtatctggggaccttctgctcaacgcagcccatgaacgtaagtccatggtgattggacacttccatgggaagttagatatacagtatgccgctagcagcactgccctgtactttggtgcgcactgcggttgtttaatcgacaacaagagtctggcctttgcttatggtaagttgtcaagaagcaagccgattctagggtgtatggtgattacagatggatgcccgcaaatcatccccatgttacttgacgattccgggaaatgggtagggagaagcaaatgaatttgctagacgcaaccgtcacccgagtgggtgcgcccgtatgggatgagcaataccaggtgtatcgtgtaaccctggagtatgactgctgggggcacaaatctgagacagagcggtggtataaagatgaatcctcagctctgagtttaaaagttggcgacataatcaaaacctaattaggggtaccaatgaaaatgggaatctgttctgtactgggtcttatctttataaccttgaaactgaccggggttatcgcctggtcctggctgtgggtgctgcttccgttctacggcggtgtagctttgctgttggcaatcctggcggcaggcggtgtggcggcagccgcggctgcaggcattaagtccgcacttaagaatcgctaggcctgtcctgcatctgcacgtaaatatcatttgaactaaacgagagggtatatgcacgctacttctctgccgcaatatttgcggtatgaccccgaatcggggaaattgcataggcctgacggttccgaggctgtgggttacattaaggatggttacagggtagtaagtgtgaagggtaggcaatactttgcacatcgactggccttcgccttaatgtgcggacgttggccgaacgttatagaccacgtaaacagaaaccgtacagataatcggtgggtcaatttaagggaggccaataaagcagtaaacgcgaagaatgcaggattgcggaaggattcccggtcggggtatcgtggagtgtcttatcgtaaaagcaatggtaagtggcgtgcctacatacaaacagatggggtacaataccacctaggattctacgctaccgcagaagaggcccacttagcaaggcaggcagttatctctcagcatcacaaacacttttctaacgaggtataaattatatgactactaatgtactggcatccttgaacgctctggtagacgcagcaatcgaaacccaagatgtagatatgcgggaaacctcacagggcggtgcgtatgaggatgtactgcttccgaagggcgaatactacggctacttcgccgagtacgtagaaatcggtaagcgcctaccaactaagggcggtaagcctactggtaagcctgcagtggctaacgtgcgcatcggtattgtggtgtacggtcctaacggtgaagtgaagcgtatccgcccgtacccgatggctatcagtaactttgagcgagcaggcttcaagaagttcttcgacaagctcaactacgacaatagcattaagcatgcagcacagcgtctggggcaggccttcaccttcccgattgatgagcacaccagtgctgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcaccgcaagcacctgcagccccagctgctccagtggctcctgcggctcctgtagcgcccgctgcgcctgctgcacctcaagcctaatctaccctaacctaaactaatatggccccgcatggggccttagaggaagactatgaacatcatcaacattctcatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgccgtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatatactgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggagaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctacgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctacccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgaagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgagcagtttgtgagcctatacgaagagcacgacctgcttggggatattactcgcgcggcagcagcagctggggcggacttgacggatttggatatgccagaagtaggttccctggacatccggcaagtgctggaatcgcctttcttcttctgctgataaatgaagttaccggagtaggaatgaagttaaaacacaccagtaaaacttccgattacactctcaaggttctgtataagtctgacgacattacagacgcagtgaagcaactgcacgaactgggccacggcattagtcggggcctggctccagagcagcactactggagagtgctgggaagtatattgggtaaacagtatatactaggagtctatgactcccaaggcggattagtcggtgctgtcagctactatccagaagctgtggaggactgtcattacgtagagcctgtgctgtatacagacttcttcgtactaaaaccggacaatggtgcggcggtgactgtgattatgcaggggatgcacgcgatagccaagtgcatgcgcgccgggcgtattgccattagccggagcacatcggataacacgtacaagacaacttatcatttagtgaggtcagaatgagtggtggtttaggtaaactgttaggtaaggccacggatatgctcggccttactgacaacgcaggattagaggcacagcagcgcttggcagagcagcaggccagcgcagctaaacaacaggctgccttagaggctaatagcgccgcagataacattgctgagattgacccagcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggtgtcttggatgcctctgagaagtttgcgcagtggacgctcagcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgcctcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacaggggcatagatggataacgtagaaaacggtcagaacgtagaaactacacaggtagagaaccaaggcggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcaccccggttcgtaacgataagatgattatcgtggtggatacggtgctgtatatccgtaacctgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacataggcctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgcggaagagtaatacgcgcccctggtgccttcgggtgccaggggcttttttttttgtccctgtcttaaaggtccaaggggtctttaatagaggaacaaatatgagagaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgtggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgctaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacggggtattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttcgatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcacacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgcgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggcagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagagttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtcttcggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggagtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattataagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcggtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggcccagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccgagaaccgaatccacaggaaaaggattctgctaagggcgcaacaattaaacctgcgcctgggcgcgtagattggaatgatgctggagataacggcctgaacgcgctggagcgtgcctccttactggcgcaggccaagaccccagctactacagccgcagagagctttgcatcgggtatgggcaacagcatcatcgctgcggctatacgtaaggcctctgctccggcatttgaccgagacctgaactttaatgccaagcagaccctgagtagcgacacccgagctaagctgtacgccccaaatcaggaagagattgagtacctacacgactcggtgtcggtcgaagattataactaccgcatgcagcagatgcttgagcagcgtgaccgtgaccgcttaatggctgacaacacagtggctgggttcgcgggtatgttggtaggcgactccccgttcatactggccctgatgcctgccgccggtattgctggccgcgcgggcttagctgcacgtaccgccatacgcgctgctgatgtaggtactgcattctatgcacaggaccaactgggccagtccgccgcggtaactgcactgatagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatcctagtatcgagaaacaataccgcctccgtgaacatgaaagcacagcacgtagttcagttcttgaagaagtctgaacacttgacagcaggccagaaggctattctggacacgctgggtgatgctgtaaacgacattgattttaaactggtagcaggctccgcaaaccgcagccgctacacttacgcacaacaagatttagctaggcgcggggaggtatctctacgcgcacctaagcgagctaatggcagcacctggactacagccggggacgcactgcgcgctatggatgcagacaccagcaaggtggccgtgcacgaactgattcatgccgccactgcgcgcgccgttgacagtaatcccgagattgctaagcgcctggaggaagtgcgcgctgttattgcagcagactccaccttgacgccgcgtatgcggtattacgcaagcaatgtgcacgagatgctggcaggcttaggcgacagccctgagtgggttgagcatctggcgcggacgaaatccccaaccggtaagagcatgctccgccaactgggtgagtacatcatgaacgccc

SEQ ID NO: 167 - DNA, 178765 bp, Unknown; identical to SEQ ID NO: 4
  source: /note="Description of Unknown: colon-1 Bacteriophage Sequence"

SEQ ID NO: 168 - DNA, 174256 bp, Unknown; identical to SEQ ID NO: 3
  source: /note="Description of Unknown: colon-11 Bacteriophage Sequence"

SEQ ID NO: 169 - DNA, 39187 bp, Unknown; identical to SEQ ID NO: 6
  source: /note="Description of Unknown: colon-14 Bacteriophage Sequence"

SEQ ID NO: 170 - DNA, 40352 bp, Unknown
  source: /note="Description of Unknown: KP2-15-1 Bacteriophage Sequence"
gtcaactggtagaacagcgaatagcgaacatcatgcttgccatcagcgtcacgggcagtctggtagtcctcacgaatcacctcgtcacgaatcacaaggcggtgcgtagagagtacaggctccagcgtatcacaaatgcgtagttccttcataccacgagcacgaatctcttccatagaggctgcatggtgtttcaggagcacagggctgaataccttaccaaacataccatccccgaagttactctcgaagaccaccgtctgaaccttccactgcttcgctttcttagcgagggactcaagggtcttgtcggaataaccatcgcggaacccgccagcttccatcagatagatgtagccattcagggtgaacaacactgcgtaaccagtctcatccttacctcgaccactagggtcaatcacgaggatgcgttgctggtactgtccagtgttctggctgcacgaatgataactatgaatatcatcacccttaaggcccacgttaggtagctcttcattgcgattctgacggttcggaagccactggtaatgcattggggctttctcgaagtccagaccgcacacgatagcgtcacggaggcgtaaggggtacttctcggcatcactcaggttcgggttgagcatgaactgcaaagtgaagccagccttaccgtattccaactcacgctcacgcaggtcttccatatcgaagcgcacggggtcagtcggttgaccttggagcatctcgaacccatcgttgaactcttcgcggagcatcggggccagacggtcgccatagtacaagtcttcctcacggctacgcggatagagcgcaggccagatgattgtggtgtacccacggttatcttcgagttccttgtacaaggtcatttcggtttgaggcgtaccaaggtagataacgcgagaagtcggcagcggtttcagaagcgcagcaaattcctgcaccagagtccacagcttctcacgggcaccttgagttgcggagttagacggaatctcaacgtcatccgctatgatgatatcagcacggctaccagtcaactgaccagtgatgcccaccgacttcacagacggagagtggtcaggcttggcagggccaacatcgaaactaatcacagagtcacgctgaccggggcgaggctttagctcagccaagaagggcagcaggtcaatgatgttcttgatgaagatggagttagcgtccgcacgttctttggatgcagagacaatcagtatcttcaactgagggtcacgccatagcgtccacacaacgaacgcacaggtgatgaatgatttaccaataccacggaaagcctgtaggataaacttcttgttgtctccgttagccagacaccgggccatatcaatctgacacttagtcggcggcgggagagccaaagccttccacaatacgaacaggaaggccacgaagtcacccttaagctgcgcaatgattagcgcattacggtttgcttgggtgtcgctcattctgcatctccttaatagtacgctggagcgctcttacgtgagcatcggcagcttgggttattccgataatacgcttagcatctgactcgtgtagttcggctcgaccattaaactcgcatctaccgttatcttctggcagtccggtaagggttttgatgcggactgacagccgcttattattactacgcaggtcattaagcatcctatcagtgctgccttcaatggctgcaatctcttcttggtactcacgggatacccgactgacctctgcctgagttgctgcggttgcttttgttttcgcaatgtattcattttggattacctccttccagtttgctctctcatgggttgaccctaagtgccagccacccataaagagtgtcccggcgagtacccaagggagtgcgctgcgtaaaagttttagcataacacctcccatcaattttcagatttcacacagatgcaccaaataacatccataaaggctccccacgtggagaaccttgagtatgtcacttactgtagcgtgatggtctcatcgtcagtcagaccattagggccgaccactttgttgtagtcttccagaccagccgcgagaccgccaaggatgttctcatccggggtcagcttactgatttggaacttatggcggtctaacagtttgccgattgcgttgtaaagctgcggcgttcggcgttcctcgctctggaggtcagcaagcatacgctgtgccatctccgtgtccagcatctccagcagcttgattaaagtcttgtcgctcataggttactccttatttgcacgtttccagtcaataatcttatcgactaccttggcaccaatctgaaccactgtgtaggcgatggctgcaacgtagaaccattcgtttaacgatagtccccaaaagagtcgggccgcaccatcagcgacccctgtgccaacaatcggcgcagccttaacgacctcgttattgaagtcaaaagaaagcattgtgttctccttatgttgtgccgtccgctggctttgttgattgtccttcgagttctttaacgcgttgacgcagtgcttgaagctcagttattacgtcagcaagcaacgccctgtcgttggtattcaaaagactaccttctgcggtggtcgttaggtatgtgtacagcgggtcaatcgtgtcaagttgttgggccagccacccacgtttacgttccccggtggcaatctctgtgtattccactatgccaattgcgtcaatacgctcaccagcaccatcaagaggtttagtgatatcatccttgattctaacatcagaacctgaagtcatcacatcaccaagtggtgtagatattttaccattggagaatagctgccagttagtatccttgctataaccattgaggttaaggattatcgcgtggtctgtaccaacgtgctcctgaatatacataccacagtacgcaccaagtggatcaccattaccaccacggccccgaagctgtgagcgaactgccacagcattgaggtattgaccaatagccggattagggggcgcatacacatatacggtagattcaccattaactcgcgttggccctgtaaagtcaaacctgttggtatctgtaataacaaaaccagcacgtaaggtggatgaagcaccagacacacggtagttctcgaagtgcatggcccctgcatcatccatataaatcctgttggcatagttcacgccattaacggtcttatcttggtatagcccactgtggttcagtattgatactttaccgtttcctttaatggtgaagtcacccttcatgacaacattgttaccgttgactgaatcaatagcggcagcaaagtcattcatgttagtcagcttagcagcctcctcagaagccttagcagcactcgatgcagcgttagtctcagaggtcttagcgttagtctcagaggacttagcgttggtctcagaggtcttagcgttgacctcagacgtatgcgcggctgttgcactttttgcggacttgagggagtaatgatacgcagagaactcgctaccctgtaccggagagtcctcagcacgctgcgcccattggtacgcgttggtctcagaggtcttagcgttggtctctgaggtcttagcgttggtctctgaggtcttagcgttggtctctgaggtcttggcagcggcctgagaggtagcagcggcgttcttagagttcagggcagactcgttccaccgagtgacttgacctaaagtgataacatcaccgaggtcaacaccatcagctacgtttatgatacgacgaccacgagcatcaaggttgccatcattgttcacaccaatggtatcagccgttaagtcacgagcctcttctgcaacgtgaagggtttgaacctgagagatgttcaggtcgtatgcccgaaggattgaaccatcggtgaagtcaaccagcctatcggtagcggaggtaaatcgacggatttcaatcatgttataaccgtccgctggccccaatgctctcgttgtggagattgtggtcttagttgcaaaacgatagtcttgattcaagatgagttcctttcggtcaacaccgataagtgtcactctgacgaacttacgcgccagatactcaaacggaatattgaagtccgtagtggagccatccagcgggtaagtcatcacggtcttaatatttgtagccatgtgacctcctttgtaaattagcattaagagagaagaggccagaatgtgacctctctccctttagtgagggtttattggcgagggcgtgttgcatcatccttaatcttgatgccctgctcttcgaagatgtgcataatcaactgttgtgtcagcgggtcattggggacaagctcacgcatggcgttgaacacaccagtacggaactctacctcactctgcttaccatcagagctaagtagcgtagaggcattcatggcggtagacccaatattcccaactagtcctacagctggtacttggttggatatcgcccctactatgttacccgcaacctccttaccagtccaagccttgtttcggtcacgttcggtcttttcctttggtaacaccgttgagcgggtgtactggtaggtatcattaccgaacaagccaccaatcatatcatagacagacagtggggaaccaaggtgtgaacttctggataatgacgcgtgggcaatcattttagggtcaagagcattctttaggtactccttacgcttgtgctcctgtaggccgtaagccttcaagtgcacctgagcaacatagtaaccaccagccagacccatagagatgattgcagtcagcgcagaatcgatagccctgttgttcttagtcgcgtcataaaacaatctgacgaagcgcgagttaagagacttgattacgaagttcttaaactgcatcaccatcttgacagccgctccgtaagccttggcgtcctgtgaggaaaccttatgcggcctaaggatagtctcatcagcaaccttatcagccagacgccataagtccatagtccgtgggtcattggcgaaagcctgtttgtcccggattgtaaacttaccgtcagcatcacgagtggcgtggtcacggaacaactgctttattcccttccactgctcaggtgacacagaggcagacttaaggtaattcgctttaccgaacttagatcctttcccagcgagcgctgccccagccacatcacccagtacaccctgtctggcagcatcgatgatgtagttagaggttccattaagcagcatcgtccaaggtgagcgcgcagacaattcctgagttccgaagcgaatagtcccaaccacattagccaccactgcgttagtgtcagtagactcccgaaggcgacggatatggtcttcgcgccccggacgcataagctggtctagttccttcccgaacaccatactgtgaatctccttaatctcagagccgctcataggcttcctccggctaacccaatcgttaagcagtgggattccatgaagtaccgcagaggtgtttcctttactcaacatagcagcaacctcagtgaagttctggaacggcatatagaagttcttagcgaagaaagccaagtcagtcatggagcgaagaatcgtaccgaaagctccctctgggttcatgcgggcacgaccagtcagaatcttcacggtgtccttgagtgcttcgacttcacctttcagtgagccgttaccctcagactgcttgtccagcgccatgatttcatctttcagttccttcgtcgtcttacccgaaccacccatgatagccacgtcaccgtcaactcgacggtcataagcaggaagaatgtcagccatatcgtagttacgcaggtcgttcacagagaacgtgctaccatccgggagggtaacagccatgtcgctgtcgaacatgttacgggcctccaagaagttattgttctcgatgccaaccagaccctcaaggttttcatcaatgatagaggaggaagtgaattggtcagtgtgcgatataccatacgccttgtccatagcgtgcttctgaaccatatctggtgttacttcctgtaccgtcttgagaccgttaagctccatcaggtactcatcgactctcgccttgacttctggacgagcgcggtaagatgtaagccacgactctgcaattgcccgttgtagtccctcgttaccgtagcgactcaccatgtacaactttatggcgcggtcatacacattaggcacgtaggttccgttatggcgtgagccggggaagatgctacgagctttggcgttaccgaagatagcagggttttccatgagttctcgcttgaggtcgaagtgttgtttcaggatatccatcaccttacgttctccctttgtgagtcccgattgtagctctggtctctcaatcgctaaggcagcacgcttatagatttcctgacgtacttccttacggctcatcttcacaccacctgtagagaactcagggtctttcattgcagtacgcacagcatcataaagctgattgtaggtgcgctgattgttcgcgtggagccgctccttaatgtcagaagcagtcgcaccgaacttaccgttagagcctgattccatccctgtcggagaacgcacaaggtcactcgcaatggagcgcacagtctcattctccgaccgaagggtcttgaggctgatctcagcgaatccacccaaagagataccacgagccgctcgctcagggttaacctgctcgaactcatgaagtgtctgagggttaatcgggttggtgtcactcaagatttgaccttgcggcagcaccacagcccccggttcagtttcaagttgagagtagtttacacccgcatgttccccgtcaaatgtacgaccctctgttggcatacgtgttaagtcctcgccaccagcttgaaaggcagactcacgcgcctccagtcgagtagccatgcggtcgaagtcgttactaacttgaccagcgcgaacacggcccaatgctgcactcactccatcagctattgcgctcatcccggccccgaacataagacccccaaggattgcatcttgatagtgcgcctcaccaccagcaacggatgtgcgaacagcttctgaaactgcgcccaaggctgcactttgggcaccaacaacgaacgccttgtttaccaccttgagaccctttccagcaacaccaacaagcggcacatagctcaatgggtcaacaccagctcccacgattccgccaaccaattgtgctcccacaccagcatcagcagccttcacgtccatctcgtagtttctcttcgccatcttaatcaggtcatcccagttatcaccgtcaccacctgtcaccactgagtagtaactcggaggaagcccactgttgcggagcttgtcaagatcctcagctgtcggctggtaggagttccatcgagttggggtaatagcgtccttgaagatgtcaaaactatcatcaaaacgcgcagcattgaaggcaacacccaatagcgagttatgaagctcggcacttgtggtgtcctttatcccgaagaatgttgaacggttttcatattcctcaacggtagttccatgtttatcgtagaaatccttagtgaacggtacggcaggttcctgttgttccacaccctccagcttaaagccagttgattgtggaagctcagttcctaccttcccggccttaccgattccagcaaaggcgtcctcagcaggaatccctttagcctttggggttatcccaccgaacgcctccaagtctcccttgcgcgggctgttagcaacatcgagaagtttacgcatgtagttgcggccctcctcgctgatagaggcccaatcgcctcggtcataagcctgcatttgtggagcgccattgcgtccctctccttggttgtacgctagggccgctttaagttcatccccgtcgtatttcctaacgaggtcgctcaggtgacgagctgctgcgtccacagccaactcagggttgaatctctcatcgtcatctccccctgtcaccttgagtccaagccccgctgccgtacctttagtgaactgcatgatacccaacggcccggtagggcttttggctttcggattgaagccagattcgttgaatgctaatttacgaagcaggtcataggagaccccatgttcatctgccgctttctgaaataacccatcatactcggatggtttcgtcttgtcgtagctcatggagcctccttatagtttactgttagtcttctttacgtccatagataaacttaggaaccttgttccgtttctcttggacacgcttagctgcttctttacgggccttggttgccgcgacgataggtgctcgcttattggcttccgttaaggctttcttctcagccgatgcagcctgttgctcagcatagttcttatacaccttgcgtagcagtgcgttatcataacttatgcccaagttggtagtggtatcgtaaatcttgattaagttaccctgttggctaaccttaagctgtttgttggtaacccaagggttttgctcttggtacttcttaacagcttgctcaatgatatccttaccttgctcccaagatttagggtcatctgttacctgcatcatgttgcgagggattacaccgtaggttccaccatctacgttatccgaagagaatgtataggtagtgtcctttaggaacgaactaaccgctgatatggcatccttagggtttcctgttaggtacttctcagagtcataaataatctgagcgtactcacgcatggaagccggaaggtatttcagttcgggctgctcagagttgttcatcagctcgctgaacgcacgctcatcctcaatctgcatttcacgcgttttcccttgacgggatttggtggcgttaatgagggcttgcggctttatcccctgtcgatccaattgatccattgtgtgaaacagctcggcatcgtcgggatacagtgctgcgaacaatccggggtcaatgttgcgcatcttgcgtagggagtcaagggctggtgtgctatcaggcatctcgccattgatgacagccgccttccactcaccacgagcatctgacaccaactgacctacagcagtgcggaatgcaccatctttagagtcagcttggaggtactgcaacttcatgcgatccttctgcgcctctggaatgtccatagcgtcaatctgcgctaacttctggttcgcgtagttcaccatatcactatggacaaactctccagtgttctcgtttgttggcatatctttgtagtcagttgagacatactcaccattgattctcttctggaactgcttgtcgatgaccaaagatttattcagggtcttacgctgcttgtccatcagcttcgcagtctcagcggcctcttgtttgaagcgcgtctgcatatgcgcttgggcatcattgagctgctggcgctcaggcgtaagttcttctccaggctgaatcttgtcgagttccgccttgataccttggagcgcctcccatcccttgccagtatcctcttggttaagcgcagagttgatactcagttggaacctctcagtcaacttcgcgtcgttctggaattgagtgtgctgtgccttaatcatcatggcctgccactgttcatcacccatcagttcacgataggtagtcgtagcgccattaagagttaccttgcggttctcaatgttctgcaagaaggcggcaccacccggacgctgtagcacgtcattcaaggacgaagagataacctgctgagcctgattgtcggtcatccctgtcaccaaggagttgtcaatgtagttctggaagaactcaccggactcaggacgagacagtaggtcagggtcagacaggacaccgttgagttcaaccttcgagttcaggatagcacccttctgcgcttggtcactcaggaaggtatcatgtgcgccatacagagcaatgttacgctcggtgatgttcgcattgaaacccttctggtactcctcatccatctcattgatgccgaactgctcagcgaacgacttcgactgttcctgtaggcgtgagtgacgatactgctccatctcttcacgagtacggaagcgaccctctttgatggcctgttgaacctcatcgtcaacgaggaacgcagcgttacgccctgtcttgaacttcaaggcttgcattgcgtatgggtcatcctgatacagcagtgtaccattctggatagcctgtcggcgctgctcaggggtcagcttacggataatctcgttggagcgctcatcggctcgttgcttatcacgttcatctttcgccatatacatatcggcaccagccttagcgaatcgactaatggagtccagaagactcgcccttggttgttcagcctgaatggttgctgcccggtagtccatacctttgacgccccggagtcgttccataccgggagtcgccatattgcctaaaacactatttagtttactagccattattacctcccggtcttggttcctttggcggcactgataggtgctgcttggttgccgcctttcttgtcaaatccaccagccgcatattgacttgcagcttcctgacccataatggacagagggtctagtacacgcatcagaccagacttacccttggcctcgctcttgtacactgcatctacttgacttgctgtggactgagtgcgtcccaattgttgcgcaaagatactagcgtagtctcggcggtaattctcggtgacactgtttgcctcccgaatgtagttgccctcttcgatacgcttgatgcgcttcatggattcgccttctagcatactctcgccgatagctgcacggatggttcccatagcttgtaccttctgcatgttacgtgaagtcaactcagaggatgcagcttcaagggcgtcccgttgttccagcgaggcgttggcattttggatattcatctctttgaccatctccattgcctgtcggcgtccagcttctgtctgtgccactcgtgccttgtcagcactgttctggctacttagagcttgggcacccatcatggcgattgggattgctgccatccaacacataatcaattccctcctaggtatgttattgccttccgaagacgctcggtgtcgtcctcgaacttcccaagagcgatgttacaggcagagcaaaggagaccacgaacagcgccagtggcgtggcaatggtcaaccgctaacgcccgtccctcaactctctcggtaagaccgcagatagcgcacactccatcttgcttaaggagcatcgcttcatattcttccagagtaattccgtacagtcgcttaaggttaaactctcgcgcctttgagtagtccttcttgtaatacacgtagtgacagggcttacagtgactccgtaggccgtccttactcttcttgtccttatagaactcggagacagccttaagttctccgcatttcttacatctcttcacgctgcctccttgagattgtgaatagttggaactgaccatcgagagtgtactcgttgtggaataccgctccgattgtctttaggaaacgaatgtgtgacttattgcctacccatacgaagttccaaatggactcgtactggttcagcatcgtatcacgatattcgactattaacttgcgaaactctaagcgctcctttaagttaaacagtgggacgtacttagaggtaaggaaccacactcggtctccctgattgccaccaattgccaacacagcgttatcgctaagcattgccacagtgttctcatcaggaattacctttggttcaacacctagtgcctcagcttccagaatgtcctctatggacggctgaaagttgtcggcatggatttgtaaacactttgtaatgtacataatgctttaacccctcgtatctattagtgtctccctttagtgagggttaattcgccgcagggagactttaagttaaatgcccgaagaacgacgaaggtagttaccctcccagccgcacccaatgatgttcagtggagttgacgcatctgactcgatagttactatgttcgtctgagcgtttccaacaaccgggaagcggtactgccctgtgccaatgttcgacctaccaacacgcagattgtcagaacccaaacgagcgccagccattgtgtagatgaactcacgggacaggttgttcacacggatggtgaacgctccagagtcctcatagtttacccacgcacgccgaagctgtaagcgaccaatatcctcggtagccgtcgagccgtcctcagcagtcttcttaatgaggaacttcgagaacgtataagtgaacgggatgttgaacccaatgtaaaccacttggccctcttggttcccatcaagtcgtaacaccgggtcactgctccaaccgttgattggcgggtctacctctataatctttccatcagggaagaccacagacactttacccttagtgaagttcatcccataaatcgctgcgaggcttatggacgtctggtaggtatcatcattatacgtcccggcagggatggtgtatttcctcttagcgtcgatgtataatctgtaaggctctcccggaatgtctatggagttcttcgtgaagtgcaagcgtcccatccacacagcatgttcattgctcatcaatacagtcattgttgagtttatcacctgtgctgcaaacaccgtaacgttgtccccaaagtcccaatgagaccacgactgctgcctgatttcttcatcaatatagaggaacttgtagatatacacccggttcggtgctccgctcgtaaggatagccgcgaagttctcagcggttgtacccgatatactgaataccccattcggtatgtagttcggaacgtgagccgtcatgtcctctgcgttcttcacagagcttacatcctgtaccgcatagtatcggttaatggatgtgaaggaagcgcgaggtgatgcaaagtatacattacgtcctacaccatgtgggcgtgccctgtcttgcacgtcgaactgagtcgtaaggttcaactctacggagcgactcgaaaggataccagaagctgtcagaacgaactgcgcttggtcagaccataggagtaactcttctgagaacggaacggcatacttcaaggttgacacccggttgtggctaaccgcaacgtcgattgggtcatcgtcggagtagtttgacacggaggccgggaagaagttgaagtatttcgaggtgcgagacaagatgatgttctccccactaaggaagcctaaacggttacggaagaagaaaatatcattgattgtctgtccggtaaacgatgggtatgggttagttgtatcatctccaacagtacgagcaccccactcaaggtacttgaagtcaaagttcccgtcagaagcacgtaccagcgcccaaggcatcgtgtggtagtgcaggtaagtccttgtgttccagccgattgtttctacccacaccttacggttgaggtcgaacctaacgtaatactggtcggcagtctttgaggtgtcacctacaatcttcacaatgtacccatctggagcattaataggcaacttctggaacgactgagcgtagtgggttacagggttgattagctggtctgcgtaaccatccttagtctgtagtccccaaacgttatcgttatttggcgcaaggatatggatgaatccggggccaacgttgaagcgccacttatttgggttttgttcattgtttgggttacctaggttattccgcaactgagccgccagcttctcagcgatggcctgaccgtcaacctcattgacgtgtgctggttgtgagccgtctggtagttgaatagcagcacgctcagccccgttgaactcgattgagagtctacgcccatattgcccaccacgaacattaatcagcgcatcaccttggtctttaaagcccggaaggttgaccgattggtcgttactctgcacaaccaccttgcggttagtaacaaaggtatagtcagccaccgttaccatccgaaggtcttcccgtgggttggctgttcgtacataagagcggtctccacgtacttggtactccttaccatcgaggtcgaacaccttaatgtcttcaccagtgaacaccgcgaaatactgctcgaactcatcgcggttgataagatgcacgtaaggttgcgcacccacatacccagcagcgccaagggtcttaaggtgaatcatcggtgggcgcttctggagaccctcggactcagaagaccaaccgttaatctgtacgctacattgttcagcgaaccggagaatatctggctgttggctgataccgcccttgaggttcttaatcgactggctaattagtgacattgtgtacctcctaaataagctattagacgtttaatcctatcagggtcatcctcaaggaaccctaatgacttgttacaggcgtggcatagtagtcctctcacctgtccagttgtgtggcagtggtctacgcacaggtgcttgaatcgaccagaagggcccttaccgcatatcttacaaacacccgcttgatcctcaagcattttgttaaaatcatcaacggttatcccataggtgttcagcaacacccacgcccggtgagactcacgttgtgtggggcttacaggcctgccgcgcttacctgactgacggcactctttgcattgggattgaccacccggtctgctcgacttaccaaactcttccaacggtttaactgtgaggcacttagagcactctttacacccgttgattatttcttttctatgtgctggcataagtgcctccttactattaacgcgtcaatagaccctgaacgaaactatcgccatcaagcatgttgtagttgccgtagtctaactcgtactcgaagcacgcacgccacgcttcctgttcttcttcctgcaacactccgtctacctccggcgcaccgaagaatcggttgttgaactggcgtgaagccttggtgacgatgtagttacggaagcactcaggcatctcatcgaactctctcagacgaatcaggttgacctgaacaccagaaggaaatctgtcagtcttcgcagagcggtcatagagatagccaccacggttgatatattgggtctgaccgctggttgccattacggacagatagtcagagctaaatggaatcataccagagaacgcatccggtagaagagtcacaccttcctcaatattgaatgtccatcctcgtgattgaatctgtcggttaatcttattgagtacacgtcgagcattcgcaacgtcagcattcgcatcaccctcaagggttgatactggtggctcaccgatggaagccagaatgtcgttgacggctgatagctcttctgcggtctcaatgttcatctcataagagcgcatgatgttacctcctgttagtgagggtttaaagcaaaaaacccctcagactcccaaagagggaacccaaggggtttgcttgttgttattgagacttaagtgccttgttacgagcacgagtaatggcggccttctgttgaggcgtgagagctacttcggcggctacctcttgggtcggctccacttcactctccgcgttcatactcaaaggcgctaccattaagccttcgaagtctttggcagcacgatagcgccagcagcttctggacgcagaccgccgtgacccatcgcatacttagcgataatctggtcagcctgatagttcgcacgacgagcgcgctccagagccaagtctttcagcttgaccgtaccaaccgcagagcggtgctggaacaggcccacaacgttatccagagcaaccttaatggtagcgctggaagtagccgggaaagcgtgcttctggtcagccggggcatcctcacgggtatcaccagcaccaccagcggtcaggtgcggaacctcaaccacttcgaagcccatcacgttacggatagtaccgcgctcagggtcaatcagtgcctgatagtttgcagcgttcggcatcagagcggccagaatcgcagagtagttatcaggagtggtgtagaaggtacggtcagcagccggaacgtagttcttggtcagggacgcacgagcgatagtcaactgagcgataatcgctttacccagctcaaccgggtcagtcaggtcgccagtcttaggcttaaccagagtcagtacggtaggcttaccgagaccctcgatgttctcattggagtcgtcaggcaggttaaccagaccagccagttcagccagcacagcaccgtcagccgccatcgccagagattcacccaactgtgcggtgtactcagcgcgaacgtcatagtggttcatcgcgtcctcaatgtcgtaaatcagcacgtccgcagtcagcagtccatcaatgttgattaccttctcggtgtgtttgatatccttacgtttgtcatcgaggttctcacccggtttcaggtaagcggctttggtgcgaccaatcacagggaactgtgcggacttaccagaagcaatagagcgcagcatgtgacgaggcatggtcacggaggtgcgagcgaaagcagtcaggacttcaccgccgaacactttcaggaacagcgccaatttgtccgctgcggactgacccttaccctgattagtaccaatttgctgtccgccttgaatgttagccatgttgaatctccttatgttaatttaaagaaaagtttggttactacttgaatcgagttggttctcaatgtttcacctacgggagcgtccacaaagttctgtgctcaggtgattcaaccattgtagtcatctatggtctctccctttagtgagggttaattagaaactggagtcgataaccttctgttctaccatttgacggtaggcagcatcactacggtaacgcgggtcactcatagctttaatcatctcagcctgattcgtaaagccctctttctgacgagctacaggtttaaccggagtagcacgcttggtaacactacggttggctggcttaccgaatttcttcgtgtaactctcaccagccagattgataattgctttgacagtcgccaagtctcggttcatcatggcagtctcaagggactcagccgcagccgggttggtcgcttcaaggtgcgtatagattgcgctaaagcgctccttaccaccagcaaaggcaaccacctgattgacgtactggtctacaagggcttcctgaccggagatgtaggagtccacaaaggcacggctatatccagcagcttcgagttccgcataggatttctcagagatgccatcggcttcgtactcttcgtagatacgagtcacagactctgcactcagtccacgctcaacggcctgctcgaccatcgactgaaagccttcttcgtgcttacctaattgttcagtcacttggctcagttcttctggagtgtcacccagcggctcaaactcagcggcctcaccttcggtatccacctcagcgttatcgctaccagtgtcgaactcagcttcgttaccatcttcactgatacgaacctgaatgcggccctcatcgtcttcaccatcagcgaatgggtcttcaccagccgcataagggtcatcgtcataagaactaggttcctcgctaagtatgattgcatcatcgccatcacgggcagcaacatcgagactcagcatattctgttcgtgttcagtaggtgtacttccggtcattaccgcgttgttcacaccgaaggacgcataaacgtctgcattagattcagccattgttaaatctcctaagttgttaaagataaagggaaaccaaaggactccaacctttagtcatcgctcatttcaaagatgaggtctccctttagtgagggttattaggtggcgtctaggccagcctgtgctgctgcaccctgcatagcttctggacttgaggtcgctagagcaccaacaccagccccaccagtggcggcggcgttctcgatacctgtttgggccgcatcctgcatcatcagtgcttgcttctgctcgtccgtcagtaggataccagaagtatcaataccaatggcgttagcaatgcgcagcttaatgacagcaaggttaatgtccgggtctccctgcataggagccagagcagcccaagcggagatacagcgctccagcttatcgaggtcttgaccacgcccgattgcttccagacctgtgctgatagtaggctcaacggcttctttcggtagctcaggaatctgcgaggttgcttggagttgcttcaagagcacacgaaccagaggcaattgcagttcttgagacagaatcgaatatacgccaccaagcgtatcttccagttctgacgcaacgtatcgaatctcttcggcggtcactcgttcacctgtgcgctgtaccgcagagttcaacataaaggcatacgataagcgtgcttctatctggtcactcacagctttcgctacggtaaagtcagcttgcttctccagttgaaggaaatcaatgtcttctcggcgaccgggaacgaagtcaccagtctgagctttggttaatctacggggctgcgtaatgccagcaggattcaccagacctatgaccttcgcactaatcatgctcatcttaactatagcctcttggagattctcaagagaccttaagtcacctaagtattcttcacagtaggagcgaccgtaagactcgccatcaatgcgaaccatgcgaaccggaatgtagggcatagcgtcagtaggataggtggcatcggagccatcaatctcaacgtcctctacttcctcgtacttgaggtaatcgccggactcttcatcgagatacacatgggtgtacacatcgaccatttcgtccatcttcttctcaccaccagctttctctaccgcagaccgaacgtcttccgggagagcaccaaaggctatctggtcacgagtgacaatctgtaacacattgccgtatgcgtctctttggacaacataagaagacaatcggtacagcttcatcggattgtagctaccttcgggttccggtaagtaaagcagtgcattacctgccacgatcaactgcttgaggcactcaaagagcgtcacacggtagctgttggattcgatataattcatgataatacgctcaaccatagacagaccttcgtccaccttagcgagtccatcagggtctccaacaagctgcttcgcctcatattcgctaatggtcagcttcatccacgactgcatcgggaataacgcaagcattaacttagaggccagattgttaagaccccgcgcacctacagcctgccacggagtcgtgtagtcggtagattcgttatcggactccttcgggaacaaggacggaatggtgtattgcgcacagttttccgcacgagtctcataggctctacggtcgttcgtcaggcggtcataggtagctttagcaccgtcttcgcccaatcctgtacgttttgaatcagccattcagtcctcctcagatattgattccaccgccggaactgcgagctacgctaagtgctttcttaccgccagcgcgtgccttcttacgtgcgctctcggtttgcgcctcatcctcgccctcagccttatcctgttcaggtacgtctacaatctgtgctggtggcggtgcagctactactggtgctggagcctcttgttggataatctcctgcttacctgcacccagcgcgcctccaacaaccttaccaacttccttacctgccttctcgactggtctgctaacttccttcacaactttcttaacagccttcttgattttcttgaagaatcccatgatgtttctccctatactatgactcagttacccaaacgcctttgagcgaatggaggatttactcttgttcttggctgcgctgtcatccagctttaccttgagactgctcttaccgctgctcggtgaggttggcacctcagaggaagacacgctggtgtcctcgtcatcatcgcctccccataccacagacttcggaggttcagtcaaaggtgctggttcagcagcgcgaatctggttagtgtccatcttagggactttcaccttcggtttccagcacatataattactcctgtctcagttgctctttacgcacctcaatctcatcaagtgttcgagaggcaaggtacagaccatgcatcacaccagcaatgaaagactcagagtaacccgcagcgcggagcgcacggtactccccggactccaccacataggcctgattgaagcgcacctgtagatactctttagctgcacgaggcatactaggaatatcatcgggatgagttaaaacatgattaattggttgtaacataatttcacctcttaaggttaagtcttaaagtaataatcataaaggctccctcttccctttagtgagggttaatacagagagccttgagtttatcacttaatctcggagtctcgattaacgtctcggactatgagagcgaacatccagagacctcgcgccagcatacctaccagcacagcgacggtaatcagctttgcggcgtccataggtaaatctccttgtcaatgtaattgtattcctcgaagcgaagaatgcgagccatctggccttgcttgatgatttcctgctcggtcatcccagctttggcaccaatggatttaatgcagtcccacagcgtctcagtcgcatcaggagcacgcttcacccacttggttactgtctgccccttgttcttaccagacttcaacacggactctacaggctccacaatgaacgggtcattcaggaaggcttctgccgtatcgccccagccgggaatccctgagtagccatcagtcatatcacccttgatggtctggaagagatgccaccaatcagcggtatctttggtctgcgtcaagatgttaccagtggtacaccacaggaagtcaacgtccgggatagtcttgaagtccttatcacaggagaccaacacagctttcttgaagccgaagacctcgtgaccagacccaatgatacccataacgtcatcaccttccagcatgtcctctttgatgtgaatgaactcatcgcgctcccacaacttcgacaggaagtcacggtagcccacaggcttacgggtcgccttacggttctccttataggtctcatcaaccagtaccttacgccagttcacatcgtcggtatacgccagaacaaccatagcgtcactccaagccttcttacgggttcggtacgattcgattgcagaatcgagaatgctccgtgccttggcgtggtcacactcaagagtccaaatgtcatctccccaatccgtctcaacttcggcagcagccattgactgatataccaaccagtcaccatccatgaccagcactccattctccataggcttaccttcacgcatctccacgaagtctttcaatgtgattaggctcattcgtcatcctccccgtaaaccatttcgactgcatcagagtatccgtcccaattatccacaccacacgccttaagcgcattcaggaactctaggtctttctccagcttatcaatatacgcgctaacatcgttccacgcatcacgggtcatcgttacggtgtcactcttaggcataatcatacgcaacctcccattcgtttcaggaagcgcacaccagaggctgtgacctcccatgctccaccatttcgaccacccacagtcaaacagctaatgtgtccacgagaagcggcctcagctacgagagccgcattgtttcgcacatagttcgactgaaaggacttagggcaacctttgatagctgccagaactttcaggtattcactcatttgaacacctcgcgcacggttgcaggtgagaatctcatcagcttctgctcggtagagcttaactcactgtgaccatcgcggataaactcacggagaccttgcttgatacagaacgcagcagcaccttccggcccgtgtgtcagaccttgaataagcagttcttgtttgaacggattcagcttctcgccagccccggccttcttagctaggtctaccagcaactcgttcagattcttctcggattcactgtcaatcacagcggtaacgtcgaaggttactttaaagtgtttggtcattgccataatgtttctcctttacgagactgcgctctttgttggttttgattatgtgttcacgcttcggtatgcactgtaagtgttctacgttgcagcacccacggttgagacacaagtggtctatctcatacccttctggtataggcccacggtgtcgttcccaaacccagcggtgaaacataaagcatttcttctcgccctttctggacgaccctatactgtaccggaagtagccatcgtgattgcgcttatgtgaaacgcagactacacacccggtcggcatcttgtggaaccttagtgtagccacgcctcccataaatactccttagtgacaaaccgcccagttcgggccaatcttaccttctgtgtctaagcgacaacggaagttccaatgttcaccaacccagcgcatagcttcttgagctacctctacgacgaccttggctatctcttctgttcggcacgcaatctggacttcatcatgaatccatcccatctgcgcaaagtcaccatcccagccatgcttcaagcctttctcaatgagcatctcttcggtcttgataatccacagcttacaaatcagagcaccagcagactgcaacaatgtgttgagcgctgcgtgtggagacctgacgtgaaccttgcgaccatccagacctttaatccaacggcgcttccactgtactttctgctcaccgccaatccaagcggaagacttaacgagagattgttggatagcttctcgtagcgctgcaatcgccggggtgttctctaagaatttcttcttgagttccttcccgcgctccttccctgccccaacaatctgaccaatcttctcatctccggctccgtaaaggaacccgtaaatgaaggtcttggcgttgtctcgcgttgggagttccgcagcgttctggttcttggtgtgaatgtcaccgttgagaatctcattcgcatactctccgttgtcgaatcgagccatgaagtgtgccagacagcgcaactctaagccactggcgtctatccctgcttgcacccacggcttgccagtaatcccatccaaatgatgttcagcaccaaaagcgctacgacactgctccccgtaaggagaacgaacgccgggtacttgtgcaaggtttgggaaactatgagtagcacgaccagtaactgcaccgttagggttaacggctccatgaatcttaccgtcatcttgaacataacgtaaccacgctttgtctccttctgccgcctgaccgatacgcttctgaatcatcaggtactctttaatcaagtcaatgcacgcctgcttctcagggtcatctactcgtacatgctccaagacctcatcgtccaccacaggcgcacccttctcggtgaacttctcaggaacccatccggcctcctgtagtttcttctgaatgtggtcacggctacttggcttgaacgtaacgaactctaccggagtatacggagcaccctccatgtagtccctcgtgtccaagtcgcaaggttcaagaccttcgcgctgtgccttattacgaggcttcttgtacacgctaccctgtttcggatagaccacgcgaggataactcggcagtggcttgcctgtacgtgggtgcttgaagagttccttaccacctttcggttgataccacgagccaaacgtttcggttaactttcgcagaagttcggcgcgtttcgctgccagttctacataaagttcctcaatggcctgtgtgttgaacgggaagccgttacgctcctgcttcgctaacagccacgctgcacgatgttcaatatccacagactcgccagcttcacgccagaataaatccgcatcgtacttcgtgaagtccataccagcagggaagtagtggaggtctgtaaggaatttctctaagagcttgacagtgacaacaacgtcttgaacgttatacgccatcatcggctcgttgaacgaaacccactcagcaccatcaacatactcttcgccctgctcttccagcatagccttgaagtcgtccttgtattcacctttcatctcgcccaagcgataaccccatgcctccagagcgtgagacccgaagcgacgaccgggtagtttcccggaacgaagaagccccatgtctgtgtctttaaggttcgcatgaagtaaacgcgagagtaccaatgtgtcaatacaattctcacggggtaacttgaagtcacgattgagttgcagctttgcgagtttctctaaagccggaacgtcatacttgtgaccgttatggaaaacaataagcccacctcgcttcacctcggcttccagcgcatccagatacgccccgaagtcgcccggacgataactatgatactcaccatcacggtagtcatagataacgccacagtgaaacttggtgactttctctaagaggttgttggcctcaatgtcacttacgagcataatgccctcctttggtttcgtgctaaatgataatcataaaggccacccttgggcgaccttgagtttatcacttctcgataatctcttgcataccagcgccgaactctaccagacgctcacggttatcaccgaccaccttgtcagcagccatagtaagggcacccatcaagcgaccgacctgcttgtcatccaaggtcattcgttgagtgtgtgctttcggagacttgtggtctttccagcggtagaccatcgtgaccttctcgccgcgcacattgatgtgtactcggcgggagaactggtcggcggtgtctggcagacggatggtgtttgcgtgagtgattgacttgctcatagtgttcgatccttactcaaagaatttgctcatggactgtgctttggctgcaatcgctgccgacttgtggatgccactaacagccgcatcggatttctcgcgggactgtttcgccaactcaatggctcgctgtgaatcagctttggccttcttgtccagcttcttggcttcgatgaagtacagttttactaccagcttgcctaaagtgttaatgaatttaaacatggtgtgtctcctatggtttgaggttgttcccgttagtgagggttaattagtggtacatgattccatcgcaatcggaatgcccacacgggcatcctttagaagtctgactgtccgtcttgttcagtccagccagtatctccttctccttcttcgccagtgtagctagacggttcaagccacccggtttctctgttgtactccatgtatccagcaattccagtgtcgccagtgaaacgacacttaagcaggcgaaccaacaccaagttaggcatatcaccttgctggttacgctccaaggcgatgatagtatcagataactgacgcaaggcaccgctaccacgtaggtcagtaatagacacagcgcgtccttcttcatgcgctttccccttctccgggttcttcaagtgacaaatcactacgagcacaacaccagttgacttagcgaacccttttagcttagtcatgaggcggtcaatcatcttacgctcatccgattcctcagaggcagacacgacgattgagatgtggtctagcactataacatcacaccctaagcctgttcgcatgtaggccagctttgctaacagcctgtcagcttcggcctccgcaaaggagtcataaaggtggaacgtatcgtctccaaatagttcatcataccattcatcgaaacgtccgtcctccgcgatagccttcttgacttcatcagactgacgcagacgaaccttattgttcaagcccatcatgtcctgaatggtatcctcaacggattcctccagcatcgctaggccaacacgtttacccattcgcttgccccaagtcagagcctgttgacgaacgaacgttgacttacccatacctgaaccggaagtgaccatgatgacttcgcctccacgggcacccaaggttctatcgttcaggccttgacagccatcaaataataaacctacagcgtactcggaggtcatagcttccttaacgcggtctttgagtgataacgcggaaacaacaccgtcaggcacccaagggttcgcgttccagatctgctccaagattgctttgtcttcacccatgatgtgacactcattggcgtccttacacggtaacacggcaacacgaaccttgccagccgggagaacctgtgcggcctcttcaactgccttacggcctgcatcatccatatcgaacatcaagataatctgctcgaactggtcaaagtattcatagttagcggcgcatgtcttcttagcagcagaggcaccgtgacccaatgatacgaccgggtacttacagtcttggagttccatcacagtgagcgcatcaatttcgccctccgtgaccacaattttcttaccgccagaccagaggtgcttcaagaacaatgcatcgctcttgtggcttccggtggtcttaaagttcttgtccttatcgcgcaccttctgcgacacgatggagccattctggtctcggtagtcggcaacctgatacattcggttgtccactttcgccagccagtagccagccttttggcatgtctccttcgagatgccacgggcagtcaggtcagagtatcgaccgttgctgtcgccgaaattccatacgtcatagctcataggcttactgcctcctgtgcgtcttctcgttgataactttgcttcacgctctttgtttgcgggtactcgatgttcacacacgaagcaccattcatgcccgtcagagtacacagagttaccatcagaagacccacagttttcacatggagcatgaaacagaaagatactatcgtcttctcgttccattgtacattccttaatcagttgcgagaacaaagggaaaccgttaagtctccctttagtgagtgttaattattcctcggtgtgttcctccgccttgattgggtctttgcactgacactgacgtgacggtacacgactcttcaacggtttatcacagcgaatacaaatcatcctcatggcatcaccctcggtcagatgtaaccagttcgttcttctcccaccagcgcttcaagtcgaaggacgggcaggctttgggtgcaacgtcatggtgagcacgaaggactgaaccctcatacttcgccagcagcgtgaccagtagactacgcagcgcttgcatttgcgcaggtgtaaagttggcgtcgaacttgcctttatcatcaatcccaccaacgaggcatacgcctacggagttgtggttgtaatctttaacgtgggaacctacagccagttcatcgcggcctgcttccacagtgccatcacgcttgatgatgaagtgatatcctacgtctaaccagccctgctctttgtgccactgacgaatctcacgaacgccaatgttctggcttggcttggttgcactacagtgcacaaagattgcttccgtagaagcgcgcgttttgaattgtaccttagccattatttcttaactcctttctttgcaattagtttatcccacggtatctccttcttaggttctttaagccactccacaggaatcagcttgtcagcaaatagaataccatgcttttcggcccactcaccgtaactggttggagaccctttgtataacttagagcggctcgaagagaataccaaacgaatgtccaactcaggcatctgctcacgaatcagtaagtgtttcttacggtcttcactatcccatagacccttggtctcaataatgattccgttgggtaggattatgtctggtgtgtacttgtggttcgatgcagggacaacatagggaatagaccacatttcatactgtcccttgattcccttacgttccagcatctccatgttcttctgctctaagccgcttctatatgaccctactcgtttaactccacgtgctgcgtaacgtgctgccatagtttacctctcttaatcgcgctgattaattgtcgagatacaccataggtctctgctaggctgctttgggtctgtgtcgagttgtaaacctccataacctgtttctcattaagtttagccatgtggtgctttgcgcctttcgggttctccctgtagacgaattgaccacggtctattgcatccttaacgttgtccttttgagtacctagcgtaaggtgctcagggttaacgcagcatttgttgtcacacttatggcgaacaacaagaccctcaggtatatccccgttgaatgctaggtaggatagacgatgcgttagttccattcggcctccgtgtctaatcctaccgtaaccacagggcatccggtagcgttgccactcccagcacccgttatgagaaacttcgctgtaagcctttagtttctctttaagttccatttaaaaatcctcatcctcatccggggtttcttcgtgctcgtcttcctgccactcctgctcatcgcgggactgacgggattcactcgcagtgtaaccaccgtcttcgacttcatcggcccactcatcttcaccgccaccaccgaaggtagccagttcgaccagcatcacggactcaagttgcagcttgacgcttgcgcccacagcggtgttccatttgtaaggcaccagagagtatttcactttcagcttagagccaccaccgataatcggaacgtcctgaatcttcttacctttgctatcgaccactaccagattgatgtgtttggtctctttggtcttcttgtcttggaaagacgcatagcatttgaacttgaaggtagtcgtaccgtcaccgttatcgaagaacggcatgtcgccctcgtaaggtttcagcggtttcttaccacgctgtgcctgcggagggttagcctcgaactcttccacggcagcagcataagcctcttcgtgagtcttcacgatttcatcgaccattgcctgacagcgcgggtctttattggaaagagtcaggtctaccttatagataccacgagggttgccgaagccacgctcttcgttgccataatccggcttactcaggtaagcataaggctcagcagtgccaagaccagaggtgtagattttcttcttgaaaccagccataatgtttctcctttgtggttaatgattgggttgttccctttagtgagggtaattaggctttcacttctggacggatgcgagtcactacgaacccagcgtcctcataatgttcagcctgtagcgttgcctcttcgagagaccgggcgaataccggaacctcaaaggactcggtgttgccttctatcgtcaggaggtatttctgttcacgttgctccactttgagcctccttaaagcgccgctcccacagcgcgtacaattgttggtaagcgtcagcagccgccttatcaccatcctcaatagcttggttccacttagcggcacaccaatcgcagcattcacgaagcgtcataacacagccccttatgtttatcaaacagttcctgatagaaagccgctttcttaaggtctttctccatagttgccagttcagatttcttgccagcacgcaggcggtacttcaaaatattcccaaggcagtacccacggaacgcctcgacggtcattgaccgggcgataacctcaatggcttccacgttgtcgaacagcatgtaatggttcgggtgggtcacgtcagacttgaattctgccttcggtgcttccacgttcggagtcttaacgtcagctttaggcagcggaatcaggttgtcaggaagaaactcagcgtgctgattaccgaagcgaaccttaacgcgacctgtgttcgagtgaccagtgaccactccgctcatgcctaagaagcgcttgaggaagtcgccggagtatcgcacagcagagttaaccgggaagcgagcctctaagtctggtttgttccaatgatgttgtagcattacagaacctccttaatccacttaacgaacagacggatgcgaggccagtaagtgaccacggcttccagatgcgggcgctctttgttcatcgccttaatgaactctccacgagtgatcagtaggtgaacacgcggcgacaatgggacgaccgaaccaatcagcggcagcttggcgttgcgctcagaggccactgctgtagagcggtcttcacggcgaaccgaaaagataccatttgatgtgttgaagtgtaaacgcatgatgttgtctccttaacaatcaggccaaatgttgtcgtcggcagccattaatccaagcgttgcgacgatagcgaataggataagccacatggtgtgtctcctgttagtgagggttaattccctagaacgaagaaaggcccacccgttaaggtgagccagtgagttggttacattttctcttgagggttgtcctcagtgcctcggaacttctcgaagctagggtgacgcagggagccgtccggggtctcttccatatagttgacctgacaggcccacccgttgtagaagtcttcaccgtgggctttaacgttggctgtgaactcgtccatcagtgcgcgagagatgttgttggcgtctactaaacgaccagtctcaagaagcacactaaagccaatcactttgccctcgttggctaaaccttcggttccccaattgacaccctgaatgataccatcagcttcacactcaggcttgagcttccaccagccagacttcttgcctcgcttgtagatgccttgtgggtctttcacaatgagaccctcgtgaccttcggcacgcttctcttcgtacagttcagtcagcgaatccatatcgtagacctcgtaggtctcagcgataagccactcgatttccgggaagtattcaaccagaagagcgcgcatggcttccacatgatacggcatcagcaggttctgtacatcgtagtcctcgccagactccgcaatgtgaatcggcatgaccgcatacaggcgcacgctcaggcgcttagtgtccaactcaaaggctactttggaacctttcagcggctcaacaccaccacggtcaaacatgaagttgttcttcttgagccacttggttctcagtaggccagaccccgtgttgaagtctacgcctttgaccatcagttcaccatccagcatgaagccatccgggaagatgcagcggtcatcgttcagtagttgctgccagcgcttatcgaaaccgttcaggtgttccagcgccgggatgaacttggatacgcgagacaaccatgcggcctcagccacgttgtcaaccacaatgttaccgcgcacaccatcatatttgatatcagccattaggtagccggaggtctccagcgctttcttaacggcagactctacgaatgacacagccttatacgggacggttttgaaaatcatcataattaatttcctctttgagtttctctaaaagttctgccgcctgttccttcgtggagcaaccagcggtgataaatgttttgtttcctcttcgacactgaccgtaccaaacttgtcggtgtttgtgccagtagacacctttgattcctgacttgttgttccggtgtactgaccgatttctgttgttctcagagcgggtcacaagtctaaggttactaggcgcgttgttaagtttgttacggtcaatgtggtctacttccattccctccgggactgcaccgttgaagtgttcccaaatgagtatgtgatggtttaaccacttaccttcataacgaacccttctatagccgtttcgaatagagccgccagtgtgacgacccgtatcccatgagagaaaggaaggactcattaagtcaaatgaaattctcataatgtttcctcctttcgttctccctttagtgagggttattacttccagtgtttcaaatcgctgtgaaccttacggagccgtgcagtctgcgcgttgatttgtacatcgctgtcgctgtgctcgaaggttctggatgccaccagatgcccggagcgtgtgaacacacggagaacctcaccggatgacctgcacatcttcgctgggttttcataactgaatgactccaccttcacggtcacgtcatggtcttcctgtagacgctctaccgcatctttgtaatcgttcaggttgccgctatagatacgtcccatcattagttccactcccgtttctgtgagttaccgcgctgttgcttgtggagtttcttcatgcggtcacggcgctcttgccactgttcgccatgctcgttgaccactgaatcgcgcttggtaaatttctcaaagttggtacgcatagtatcttacctcatgttgatgtgtattgaaagttaatcacaaaggccaccgctggtgatgaccttaagtttaactctcccgttagtgagggttaactgtatgcccgttcgatacgaccacatgttgaacctttcgggtagtagaaggatttcatttcgttgtcctcagtggtctggaagatgaccatcccggaggccgttgagtaacattccaacttcgtgaccaccttaccgcacggcctaagcctaacttaaattcagtcttgcggaggtcatcactaccgggcatccaagcgtagaacttaacggaagtcaagcggtttaacttaaagatgttcttaaggaaagtcttaatgttaatcataaatttaatctcttagtacctaaagtgtcttaaagtgggagaccttaagtagtctcccgttagtgagggttaatgctaagtgcttgttatgcaaaggcaaagtcagacttgagaatgtcttgcaggttcaggttccctttcttcggaagcggaggcatcttgtccagttgtgtctcgtgtagctggtctgcaaactggtcatagaagtctgccagcacatcgttgttctcgtaggtgagaaccatcgtttcacgcacagccttaaagagcttaccagcgtctgccggaatagtcccaaagctgtcatggatgagcgcaaaggactcaatgccatacttctcgtgagcataaacgactgtcatgcgtaggtggctaccgtcctgtgagtgaacaaagttaggagcgatgccagactcctgcttgtgtgcgtcaatgcctgaatccttgagggtattaatcgtcggttgcagacggaattgccctaagaaaatcatatcaagacgcttctggagtggcttgcggtattcctgccagaccgggaagccgtcaggcgtagtccagtgaaccgcgcaacggtggcgcagaatctccttggtcttcttgtccttgacctcagcagccagcagcttagcggcagacttgagccagttcatcgcctcaaccgctgcgactacggtcacgctcaccgcgtcccaaatcagcttagccatatagccagccgcttggttaggttgggtgaacatcaagcccttaccgctgtcaatcgcaggctgaatggtgtcgtccagtacctgttgacgaaagccgaactccttggaaccgtaagccagcgtcatgaccgaacgtttagttacgctacgggttacaccatatgccagccactgttgcgccagcgttgaggttcccagcttgagcttctctgagatttccccggtgtccttgtcggtcacggtaatcatctcgttaggcgtgccgttgattgcatcctgtttgagaatctcgtttactttctgtgcaacgatgccgtaaatgtcctgcacggtttcgcttggcagaaggttaaccgcacgaccgcctacctcatcgcgtagcatcgcggagaagtgctggataccagagcaagacccatcgaacgccagcggcagagagcaattgtagctaagaccgtggtgcgcaactcctgcatactcgaagcagaacgcgaggaaacagaaaggtgaatcctgctcggcccaccaagtgttattgattgggtctttagcgcaagccagaatgtcgtctacgtgcttctcaatgaacgcgatgcgctcagggaaaggaaccttatcgacacccgcacagttcgcaccgtggattttcagccagtagaacccttcctcaccgattggcttgcctttagcgagggtcagcagacctttcgtcatgtcgttgccttgcgggttgaacatcggcacagcgtacacacgaccgcgccagtccatgttgtaagggaaccagattgctttcttgtttgcaaacttgttggcctgctccagcatgaactctaagctgatacggcgagacactcgtgccttgtccaagcggtagataccagcggcggctttcttccactccttgagcgctgcctcgttggtgtcaatgtcgtccggcttaggcggtaactcttggcgctccagtgatggaatgtctgctaccgggcaattcttccagttaacaatttcattgacaaccgcaagaactttcttgttgattttccatgcggtgttctgtgcgatgttgaccgccttgtaaacttctggcatgtaaacatcctcatagcgcatcagtcccttcttagagtgagtgcgaacgagtgccaaaggtctgcgaccgttagcccaatagccgcccccggtgattgccacccaaggtttcggcggtacgacacacggctggaacatcggagagatacccgccagtgctcctgcacgcttcgctaacacatcgacgtactcttgggccagttgcagtgcctcatggtcagagcctgcgttacctgcgttgtggcgctgcaattccaccagacccgtggactcaatgagcatttcaatcagtcgaatccctacgtgcatcgtggtttccttgtcccagctagaccacgcctcgcctcccagcagcccgcgaccaatcatatctgcctcaaccacctgcataaaggctttcttgtagacttgcccgtggcgcttgttaagctgttcctcaacgtgcttcttgaagtgcttcgcttcgaggtcacggatacgcccgaaacgtgcctcatcctcaatggccttccccaacataccagcagcggcctgaatggttgtcatgttcgtgctggtcagtgatgcaaggataactttcagggtgataaacgcggaggcttccggcttgagtaactggagcggcgcgtatgcgctaggcttgcggcctttcttagaggcgtactcttcgagccactcaacgatgcgtgcggttaacttagggagaagcgtagcgagtaacggcttagcggctgcgttgtctgcaatctcaccagctttcgcttgacgctccagcatcttgaggaagcggcgctcacctaactcataagactcgtgctctaaagccagttgttcacgagccagtgcgctgccgtagtggtctgccagcgtgttgaacgggatagcagccagttcgatttcagagaagtcattcttttcgatagtttcgatgatgttcattgcttgcctcactatggataaatcgttcctattcaggccacctcatgatgacctgtaagaaaagactctatcaaccttgcagtctcttgtcaaggtatgcgtctatgtgtaacggcttgccccatacgatagccttgtggtctatctgtgccatctgtgcggctgctaacagttcgagccgtgcgaagtcaacattcatgtgctgcacccaagcgttacgccagtgcttatcgccccacaacatgcgcgccctcggctcggccctgcgttgctcgttgtcatccatgcgcatcttagcgattaccttagcgtcacgtttagcacgcttagaggcctttctgcgccatttggcacgggctttacgtgctgcctgaaagtctcctttagggtcacggcgtgccttgcgtgccttacagcggtcaatcgcttcctgcgccctcagcgcctcaatctcagcgattagttcatccgggtcacagtgaaactcacccggctttaacttgttgtctgcgctgaacgataccgggtctgtgataatcaatcggcccatttggtctttcatcatgttaccgctgtgacaatcgaacgatgcaatgcctaggaagaacttgcggatatccttgcaggtctcaatgaacccgtcacttatcgggtactcttcggcggtatcgaagcaatcctcctcaatgatttcccgtgcggcctgaaagtggtgacgaatcttatcgctttcaccgtagcaccaatcgttaagcggtgtcagatagtccaagaccaccgtgtagcagcctgtatgacgctgaatgtcgtacaccgtagggataccctcacgaccctgattcatgcggcagaaggcagcataggcagcgcctgagtcctctttcttaaagcctaccttgataaccttgcccggtaacaatgcgtgctcgtatgctgcgctaaagtgaccgttacccaagcgtacaaatccaacatcacgcatacgctcagccagtgtctgccagtagtccatagactccaagccccaattgcctttggcctgcgtcagttcgccgtcttgagtctcatcgttcacgatagcagccgcaagagccaccagcatgggctggcgttcatccaagcggtcaatcggcaggttgcggatagcttcgagtgcggcttgtgcttcggtgaaagtcattgttcagtgtcctgttatctgtaagaagagtaaagagtaaattcagcccatttgacagcgcttgcagcctgtcgtgcggtcatcttgcggtgtctcgttaagatgcgtttgaccttgcgtttcgatgcaccataagccatcgcatacagtgcaatctttacgtgttttgagttagtgcgtagcaatgtagaatactcccaccttgttggccttaaagcgtccgttacgttcacgaaccgtaaaccgtgggatgaatccccacttaaagtaactcagcgttgccttgtgtattgccagaccgcgcttaaagtctcgcataaagtacatagcgatgcacagatagaccagtgcgattagtgcgataatcatttcttaatccatacctcgtacacaaagttgattgcagcgggtattgctatacagagaattatcaggttcttcgtgtcttcgtatcccatactctcatcctctatcgtaatgttaatcataaaggccactcgcatggagcgaccttgagtttaccacctgatagacttgaagtctgttgtcagtcgttccagcctgcacatgttgcttggtgtatcacacaggcttggtactcctcttgtgccaaaacaaggtttacccagtgcgtgacctgtttaccgtatcgcacaacataggtgcatcccattgacccgtggtaatactcacgcagcgttacagtgcattggcctttgattttagaggttgccagtaacttactcattacataacctcccatacagccgtaccattaggtaaacgcttgccgaagccttgttgatccctgaatctggcacgagcgtccctttcgttgtacccgtagcaggtcattgagtagcaccagccgggaataaggatggcgtattgtttcatagtcatatcctctcaggtttgtttagtaattatcattcaggccgctacgagctaacgacctgtagttaattactaataagctatgtctttcagtgcaaccttgagcatagtttcgatgtgcgaatcattgatatctgttatgtgcccgccgataactgtcaccgtgttgtgctctgcgatgattcttgtagtctctttaaagcccactgcatgataacagtcccacatgaatctgcggaatgtaagccctttctccttataaacccgtgcaacatcagcaatccctcccacgttgtgtgcggctcttgattcgattgctgaccgcatagctaccgctgtgtctttatttaagcgcatggtgtgattccttcatagtcaaaaagtgataatcataaaggccacgcatcgtgcatgaccttgagtctatcacttactgtacttgccagcggcggccgaactcgtcaatcgtaaagcaccctttcagtggtgcgcctttaggaacctcttggaagctacccggcaggcgttcagccttatacccgtcgatacctttagcgtacaccaatcccgctgtgtgagtctgtgatttgtataccagtacgcaatcttgctcatactcattgcaagctaagcgagctacctgtagtgcctgctctttgttcttgcagagtacacgcatggtcttttcctcggttggagccagtgcgatactctcacgatagcacccggtcaaatcggtagactcaagctcgccgtagatacccggtgcggcacgtaattcgctcaccatgtggcggtggcgactcatgttcacctcatcatcaaggttagaacggaatgctgacaccagtacatagaagacgttagcaggctctttagtgaaaatcatttggtgttacctcatgttagttcgtgttaagtgaatatcataaaggccacgctttcagtgcgaccttgagttattcgcttatacatcggtacactcaagagctattatccagattgttaaagaactttaggctacagtttcgttgagccgaggctatttcagtgttagccgtcacttgcgttataagtgcgacaagctctttattatcgtggtcgcttgtgctttcgccatctatccactatgtcgcgtttttacacctacgacactcggtgtctttcatgtggtacatcgtaccgtgtttacttcatgttgtcaaccatttttgtttcgctttatgtgccgtggtgcgcttaagtcacctagaagacaccagagcggtggttaacgttatgtggtacatcttactgcatgttacttcatgttgtcaatgcctgtttttcgtatgacttatcaggctgtctacttatccggttgactccagtatctcagggagtggctttaaggccgttgtcccgttgacgtgatgaataatagccttaagggttacttaaagtcaaccattaaattaaatctttttattaaatcccttattccctctttaagtatcccttattccctttagtgagggtttatgaaatgactacagataactacaaggcatcactacaggttaacaatgggtctatcggtctggttgtctttaagatagcggcactctttaggtgatggctttaggtctggtctttaggtggtggctttaggtctggtctttaggtggtggctttaggtgatggctttagggtttactttaggaggataacagatagggacacaaagagagatgtactatcgaactggtacactaggacactcttcaaggcctctttaagccatccgcctctttaggtattgactttatgcaacactttaggctatcctataggccacttgaggagatacccaaggttaaccgaaggttaaaccctaggggtagggctggctttaggtggctttaggagggctatgggggtactttggtttcttgaactgtgagatacccattcagatttttgtggtaaattcttaaagggtctctttaggcaaccactttaggtaaggccacaccataggtgagaccataggcgcatccagaagggatagctaggagacaccagaagaccctgtaagaccattacgaactacagggcatctttaggtataacctttagggttgactctacagggatgagttggtgtagtgaaactatacctacgaatccctcagagccgcttgtctgtcatcaacaataatttaatccccacaagagagtatagagcaaaaggccacttccagttgaccgaggtggtcagtaaggcctgcgtacccaagggtagcagtaagtaccagaagaaatcgccaagtgactctatgacgcagcagggcaatcagcaagcgtaacattgagccacctcctttcagttgctctaaggtaggtgattatataatgataatatcaccaatcacagaggtagacttaaagtgcataaaaggtcattgcataacctgaatgactaacctatatagtagctttaagtcccctctctccctttagtgagggttaattcaaactcattgattcttaaggagtttcttaaagtgaccatccgtggtctcgatgcttccttatgcactcaatatgcataactaccagtcaatgaacctgttgctattcgcatcgtcatcctcccaatagagttccatcccgtcaaccatagcggtaactacatgaccagccgaatggattgggtgctccatgtgttcctctaagaacgcctcaagcacctcagcttccaccttcacggcgtccagttccatcgtagagcgtaagaactccacacccaatgctaatgcatcaagtcggtcatcgtgggccacagcgcccttctcacgagccatacgg
